(12) United States Patent
Bell et al.

(10) Patent No.: US 7,973,139 B2
(45) Date of Patent: Jul. 5, 2011

(54) ANTIBODIES AGAINST NOGO RECEPTOR

(75) Inventors: Adam Bell, Germantown, MD (US); Craig A. Rosen, Laytonsville, MD (US)

(73) Assignee: Human Genome Sciences, Inc., Rockville, MD (US)

( * ) Notice: Subject to any disclaimer, the term of this patent is extended or adjusted under 35 U.S.C. 154(b) by 1381 days.

(21) Appl. No.: 11/090,847

(22) Filed: Mar. 25, 2005

(65) Prior Publication Data

US 2005/0215770 A1 Sep. 29, 2005

Related U.S. Application Data

(60) Provisional application No. 60/556,386, filed on Mar. 26, 2004.

(51) Int. Cl.
- *C07K 16/00* (2006.01)
- *C07K 14/00* (2006.01)
- *C12N 15/85* (2006.01)
- *C12N 5/12* (2006.01)
- *A61K 39/395* (2006.01)

(52) U.S. Cl. ............... 530/387.9; 530/387.1; 530/388.1; 530/388.22; 530/391.3; 530/391.7; 435/325; 435/326

(58) Field of Classification Search .................. None
See application file for complete search history.

(56) References Cited

U.S. PATENT DOCUMENTS

| | | |
|---|---|---|
| 4,002,531 A | 1/1977 | Royer |
| 4,444,887 A | 4/1984 | Hoffmann et al. |
| 4,631,211 A | 12/1986 | Houghten et al. |
| 4,676,980 A | 6/1987 | Segal et al. |
| 4,716,111 A | 12/1987 | Osband et al. |
| 4,816,397 A | 3/1989 | Boss et al. |
| 4,816,567 A | 3/1989 | Cabilly et al. |
| 4,980,286 A | 12/1990 | Morgan et al. |
| 4,994,560 A | 2/1991 | Kruper et al. |
| 5,112,946 A | 5/1992 | Maione |
| 5,122,464 A | 6/1992 | Wilson et al. |
| 5,223,409 A | 6/1993 | Ladner et al. |
| 5,225,539 A | 7/1993 | Winter |
| 5,274,119 A | 12/1993 | Frazier et al. |
| 5,342,604 A | 8/1994 | Wilson et al. |
| 5,349,052 A | 9/1994 | Delgado et al. |
| 5,349,053 A | 9/1994 | Landolfi |
| 5,356,603 A | 10/1994 | Hochella et al. |
| 5,359,046 A | 10/1994 | Capon et al. |
| 5,403,484 A | 4/1995 | Ladner et al. |
| 5,427,908 A | 6/1995 | Dower et al. |
| 5,428,139 A | 6/1995 | Kiefer et al. |
| 5,435,990 A | 7/1995 | Cheng et al. |
| 5,436,146 A | 7/1995 | Shenk et al. |
| 5,447,851 A | 9/1995 | Beutler et al. |
| 5,474,981 A | 12/1995 | Leder et al. |
| 5,489,425 A | 2/1996 | Kruper et al. |
| 5,505,931 A | 4/1996 | Pribish |
| 5,516,717 A | 5/1996 | Hsu |
| 5,530,101 A | 6/1996 | Queen et al. |
| 5,565,352 A | 10/1996 | Hochstrasser et al. |
| 5,571,698 A | 11/1996 | Ladner et al. |
| 5,580,717 A | 12/1996 | Dower et al. |
| 5,585,089 A | 12/1996 | Queen et al. |
| 5,605,793 A | 2/1997 | Stemmer |
| 5,612,460 A | 3/1997 | Zalipsky |
| 5,622,929 A | 4/1997 | Willner et al. |
| 5,635,384 A | 6/1997 | Walsh et al. |
| 5,652,371 A | 7/1997 | Stoltefuss et al. |
| 5,658,727 A | 8/1997 | Barbas et al. |
| 5,696,239 A | 12/1997 | Wilson et al. |
| 5,698,426 A | 12/1997 | Huse |
| 5,714,711 A | 2/1998 | Schumacher et al. |
| 5,735,743 A | 4/1998 | Murata et al. |
| 5,750,753 A | 5/1998 | Kimae et al. |
| 5,756,065 A | 5/1998 | Wilson et al. |
| 5,766,883 A | 6/1998 | Ballance et al. |
| 5,780,225 A | 7/1998 | Wigler et al. |
| 5,807,715 A | 9/1998 | Morrison et al. |
| 5,808,003 A | 9/1998 | Subramanian et al. |
| 5,811,238 A | 9/1998 | Stemmer et al. |
| 5,821,047 A | 10/1998 | Garrard et al. |
| 5,830,721 A | 11/1998 | Stemmer et al. |
| 5,834,252 A | 11/1998 | Stemmer et al. |
| 5,837,458 A | 11/1998 | Minshull et al. |
| 5,876,969 A | 3/1999 | Fleer et al. |
| 5,969,108 A | 10/1999 | McCafferty et al. |
| 2002/0199213 A1 | 12/2002 | Tomizuka et al. |
| 2003/0091995 A1 | 5/2003 | Buechler et al. |
| 2005/0221420 A1 | 10/2005 | Barske et al. |

FOREIGN PATENT DOCUMENTS

EP 239400 9/1987

(Continued)

OTHER PUBLICATIONS

Rudikoff et al, Proc Natl Acad Sci USA 1982 vol. 79 :1979-1983.*

(Continued)

*Primary Examiner* — Dong Jiang
*Assistant Examiner* — Sandra Wegert
(74) *Attorney, Agent, or Firm* — Foley & Lardner LLP

(57) ABSTRACT

The present invention relates to antibodies and related molecules that specifically bind to the Nogo receptor (NogoR). Such antibodies have uses, for example, in the treatment of spinal cord injury, brain trauma, paralysis, degenerative nervous system diseases, and stroke. The invention also relates to nucleic acid molecules encoding anti-NogoR antibodies, vectors and host cells containing these nucleic acids, and methods for producing the same.

15 Claims, 1 Drawing Sheet

FOREIGN PATENT DOCUMENTS

Figure 1:
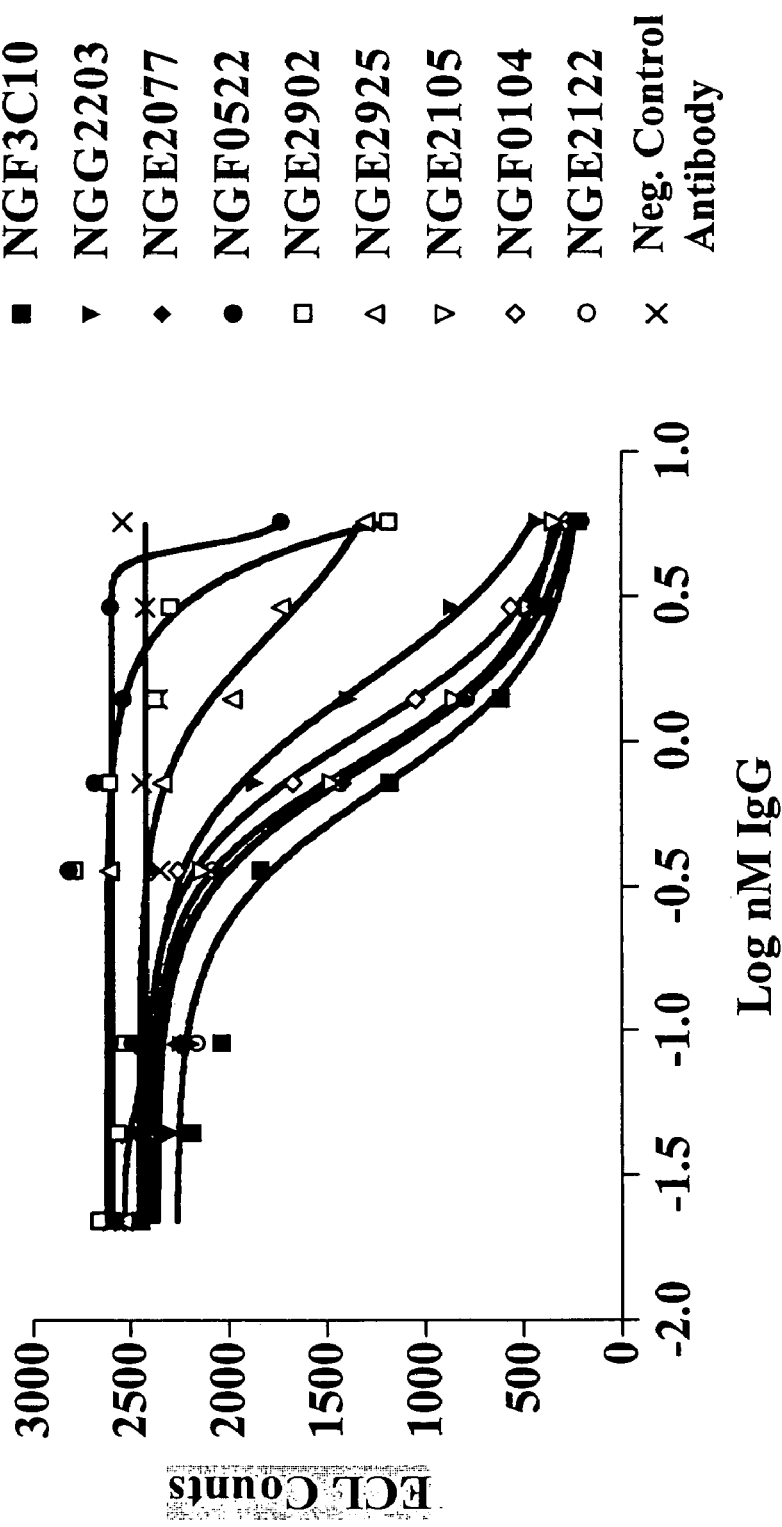

| | | |
|---|---|---|
| EP | 307434 | 3/1989 |
| EP | 367166 | 5/1990 |
| EP | 394827 | 10/1990 |
| EP | 0 413 622 | 2/1991 |
| EP | 439095 | 7/1991 |
| EP | 0 322 094 | 2/1992 |
| EP | 519596 | 12/1992 |
| EP | 592106 | 4/1994 |
| WO | WO 86/05807 | 10/1986 |
| WO | WO 87/04462 | 7/1987 |
| WO | WO 89/01036 | 2/1989 |
| WO | WO 89/10404 | 11/1989 |
| WO | WO 90/02809 | 3/1990 |
| WO | WO 91/06570 | 5/1991 |
| WO | WO 91/06657 | 5/1991 |
| WO | WO 91/09967 | 7/1991 |
| WO | WO 91/10737 | 7/1991 |
| WO | WO 91/10741 | 7/1991 |
| WO | WO 92/01047 | 1/1992 |
| WO | WO 92/06180 | 4/1992 |
| WO | WO 92/18719 | 10/1992 |
| WO | WO 92/20316 | 11/1992 |
| WO | WO 92/22715 | 12/1992 |
| WO | WO 93/11236 | 6/1993 |
| WO | WO 93/14188 | 7/1993 |
| WO | WO 93/20221 | 10/1993 |
| WO | WO 93/21232 | 10/1993 |
| WO | WO 94/02602 | 2/1994 |
| WO | WO 94/12649 | 6/1994 |
| WO | WO 94/20540 | 9/1994 |
| WO | WO 95/06058 | 3/1995 |
| WO | WO 95/07297 | 3/1995 |
| WO | WO 95/15982 | 6/1995 |
| WO | WO 95/20401 | 8/1995 |
| WO | WO 96/04388 | 2/1996 |
| WO | WO 96/14328 | 5/1996 |
| WO | WO 96/34095 | 10/1996 |
| WO | WO 96/34096 | 10/1996 |
| WO | WO 96/35735 | 11/1996 |
| WO | WO 97/13844 | 4/1997 |
| WO | WO 97/34911 | 9/1997 |
| WO | WO 97/35899 | 9/1997 |
| WO | WO 97/35904 | 10/1997 |
| WO | WO 97/49726 | 12/1997 |
| WO | WO 98/06842 | 2/1998 |
| WO | WO 98/07880 | 2/1998 |
| WO | WO 98/16654 | 4/1998 |
| WO | WO 98/18921 | 5/1998 |
| WO | WO 98/24893 | 6/1998 |
| WO | WO 98/30693 | 7/1998 |
| WO | WO 98/30694 | 7/1998 |
| WO | WO 98/32466 | 7/1998 |
| WO | WO 98/41629 | 9/1998 |
| WO | WO 98/46645 | 10/1998 |
| WO | WO 98/50435 | 11/1998 |
| WO | WO 98/54202 | 12/1998 |
| WO | WO 98/55623 | 12/1998 |
| WO | WO 98/56892 | 12/1998 |
| WO | WO 99/23105 | 5/1999 |

OTHER PUBLICATIONS

MacCallum et al. J. Mol. Biol. (1996) 262,732-745.*
Pascalis et al. (2002) The Journal of Immunology 169, 3076-3084.*
Casset et al. (2003) BBRC 307, 198-205.*
Vajdos et al. (2002) J. Mol. Biol., 320, 415-428.*
Holm et al. 2007, Mol. Immunol, 44, 1075-1084.*
Chen et al. 1999, J. Mol. Bio. 293, 865-881.*
Wu et al. 1999, J. Mol. Biol. 294, 151-162.*
Davies, et al., "Antibody VH Domains as Small Recognition Units", *Biotechnology*, May 1995, vol. 13, pp. 475-479.
Martsev, "Antigen-binding VH Domain of the Monoclonal Antferritin Antibody F11: A Functional Molten Globule", *Research Signpost, Protein Structures: Kaleidoscope of Structural Properties and Functions*, 2003, pp. 325-240.
Martsev et al., "Partially Structured State of the Functional VH Domain of the Mouse Anti-Ferritin Antibody F11", *Federation of European Biochemical Societies*, Apr. 2002, vol. 518, pp. 177-182.
Ward et al., "Binding Activities of a Repertoire of Single Immunoglobulin Variable Domains Secreted from *Escherichia coli*", *Nature*, Oct. 12, 1989, vol. 341, Issue No. 6242, pp. 544-546.
U.S. Appl. No. 08/759,620, filed Dec. 3, 2006, Jakobovits et al.
U.S. Appl. No. 07/466,008, filed Jan. 12, 1990, Kucherlopati et al.
U.S. Appl. No. 07/710,515, filed Nov. 8, 1990, Schally et al.
U.S. Appl. No. 07/919,297, filed Jan. 24, 1992, Kucherlopati et al.
U.S. Appl. No. 07/922,649, filed Jan. 30, 1992, Kucherlopati et al.
U.S. Appl. No. 08/031,801, filed Mar. 15, 1993, Kucherlopati et al.
U.S. Appl. No. 08/112,848, filed Aug. 27, 1993, Kucherlopati et al.
U.S. Appl. No. 08/234,145, filed Apr. 28, 1994, Kucherlopati et al.
U.S. Appl. No. 08/376,279, filed Jan. 20, 1995, Unknown.
U.S. Appl. No. 08/430,938, filed Apr. 27, 1995, Kucherlopati et al.
U.S. Appl. No. 08/464,584, filed Jun. 5, 1995, Unknown.
U.S. Appl. No. 08/464,582, filed Jun. 5, 1995, Kucherlopati et al.
U.S. Appl. No. 08/471,191, filed Jun. 5, 1995, Unknown.
U.S. Appl. No. 08/462,837, filed Jun. 5, 1995, Unknown.
U.S. Appl. No. 08/486,853, filed Jun. 5, 1995, Unknown.
U.S. Appl. No. 08/486,857, filed Jun. 5, 1995, Kucherlopati et al.
U.S. Appl. No. 08/486,859, filed Jun. 5, 1995, Unknown.
U.S. Appl. No. 08/462,513, filed Jun. 5, 1995, Kucherlopati et al.
U.S. Appl. No. 08/724,752, filed Oct. 2, 1996, Kucherlopati et al.
U.S. Appl. No. 08/759,620, filed Dec. 3, 1996, Jakobovits.
Altschul et al., *J Mol Biol* 215:403-410 (1990).
Altschul et al., *Nucleic Acids Res* 25:3389-3402 (1997).
Ames et al., *JImmunol Meth* 184:177-186 (1995).
Arnon et al., "Monoclonal Antibodies for Immunotargeting of Drugs in Cancer Therapy", in Monoclonal Antibodies and Cancer Therapy, Reisfeld et al. (eds.), pp. 243-256 (Alan R. Liss, Inc. 1985.
Ashkenazi et al., *Proc Natl Acad Sci USA* 88:10535-10539 (1991).
Ausubel, F.M. et al., eds. 1989, Current Protocols in Molecular Biology, vol. 1, Green Publ. Associates, Inc. & John Wiley & Sons, Inc., NY, pp. 6.3.1-6.3.6 and 2.10.3.
Baldwin et al., Analysis, Results and Future Prospective of Therapeutic Use of Radiolabeled Antibody in Cancer Therapy, in Monoclonal Antibodies for Cancer Detection and Therapy pp. 303-316 (1985 Academic Press).
Bebbington et al., Biotechnology 10:169-175 (1992).
Beck et al., *Proc Natl Acad Sci USA* 89:11357-11341 (1992).
Biblia and Robinson, *Biotechnol Prog* 11:1 (1995).
Billat et al., *Expt Hematol* 10:135-140 (1982).
Bitter et al., *Meth Enrymol* 153:516-544 (1987).
Blasco, *Biotechniques* 24(2):308-13 (1998).
Boesen et at., *Biotherapy* 6:29 1-302 (1994).
Bout et al., *Human Gene Therapy* 5:3-10 (1994).
Brinkman et al., *J Immunol Meth* 182:41-50 (1995).
Buchwald et al., Surgery 88:507 (1980).
Burton et al., Adv Immunol 57:191-280 (1994).
Chen et al., *Hum Gene Therap* 5:595-601 (1994).
Chen et al., *Nature* 403:434-439 (2000).
Chintalachanuvu et al., Clin. Kimono 101:21-31 (2001).
Chothia & Lesk, *J Mol. Biol* 196:901-917 (1987).
Chothia et al., *Nature* 342:878-883 (1989).
*Clin Pharm Ther* 29:69-92 (1985).
Clowes et al., *J Clin. Invest* 93:644-651(1994).
Cockett et al., BioTechnology 8:2 (1990)).
Cognote et al. in abstract 364, *Proceedings 7th Intl. Congress Endocrinol* (Quebec City, Quebec, Jul. 1-7, 1984).
Cohen et al., *Oncogene* 17:2115 2456 (1998).
Cohen et at., *Meth Enrymol* 217:718-644 (1993).
Colberre-Garapin et al., *J. Mol. Biol* 150:1 (1981).
Crouse et al., Mol. *Cell Biol*. 3:257 (1983).
Cull et al., Proc Natl. Acad. Sci. USA 89:1865-1869 (1992).
Cwirla et al., Proc Nail Acad Sci USA 87:7178-7182 (1990).
David and Aguayo *Science*, 214:931-933 (1981).
Delgado et al., *Crit Rev Ther Drug Carrier Syst* 9:249-304 (1992).
Devlin, Science 249:404-406 (1990).
Domeniconi et al., *Neuron* 35:283-290 (2002).
During et al., *Ann* Neurol 25:35 1 (1989).
Felici, *J Mol. Biol* 222:301-310 (1991).
Fell et at., *J Immunol* 146:2446-2452 (1991).
Fodor, Nature 364:555-556 (1993).
Foecking et al., *Gene* 45:101 (1986).

Folkman *J Pediarr Surg* 28:445-51 (1993).
Fountoulakis et al., *J Biochem* 270:3958-3964 (1995).
Fournier et al., *J Neurosci* 22:8876-8883, (2002).
Fournier et al., *Nature*, 409:341-346 (2001).
Francis et al., *Intern J Hematol* 68:1-18 (1998).
Frigerio et al., *Plant Physiol* 123:1483-94 (2000).
Gao et al., *FEBS Lett* 347:257 (1994).
Gentz et al., *Proc Nat! Acad Sci USA* 86:821-824 (1989).
Ghetie et al., *Proc Nall Acad Sci USA* (1997) 94:7509-7514.
Gillies et al., *J Immunol Methods* 125:191-202 (1989).
Gillies et al., *Proc Nall Acad Sci USA* 89:1428-1432 (1992).
Goel et al., *Cancer Res* 60:6964-6971 (2000).
Goldspiel et al., *Clin Pharm* 12:488-505 (1993).
Goodson, in Medical Applications of Controlled Release, *supra*, vol. 2,_pp. 115-138 (1984).
Grandpre et al., *Nature* 403:439-444 (2000).
Grandpre et al., *Nature* 417:547-551 (2002).
Green and Jakobovits, *J Exp Med* 188:483-495 (1998).
Green et al., *Nature Genetics* 7:13-21 (1994).
Green, *J Immunol Meth* 231:11-23 (1999).
Grossman and Wilson, *Curr Opin Genetics Devel* 3:110-114 (1993).
Hammerling et al., Monoclonal-Annbodies-and—T-Cell, "Production of Antibody-Producing Hybridomas in the Rodent Systems," pp. 563-587 (1982).
Hansson et al., *J Mol. Biol.* 287:265-76 (1999).
Harayama, *Trends Biotechnol* 16(2):76-82 (1998).
Hellstrom et al., "Antibodies for Drug Delivery", in Controlled Drug Delivery (2nd Ed.), Robinson et al. (eds.), pp. 623-653 (Marcel Dekker, Inc. 1987).
Holliger et al., "'Diabodies': small bivalent and bispecific antibody fragments" *Proc Natl. Acad Sci. USA* 90:6444-6448 (1993).
Holmes et al., *J Biol. Chem.* 262(4):1659-1664, 1987).
Houghten, *BioTechniques* 13:412-421(1992).
Houghten, *Proc Nall Acad Sci USA* 82:5131-5135 (1985).
Howard et al., J Neurosurg 7 1:105 (1989).
Hunt et al., *J Neurocytol* 31:93-120 (2002).
lngber et al., *Nature* 348:555557, *J Exp Med* 188(6):1185-1190),1990.
Inouye & Inouye, *Nucleic Acids Res* 13:3101-3109 (1985).
Islam et al., *Agric Biol Chem* 55:229 (1991).
Joliot et at., *Proc Nail Acad Sci USA* 88:1864-1868 (1991).
Kalmani, *Kidney Int*, 22:383-391 (1982).
Karlin and Altschul, *Proc Nail Acad Sci USA* 90:5873-5877 (1993).
Karlin and Altschul, *Proc Natl Acad Sci USA* 87:2264-2268 (1990).
Keen and Hale, Cytotechnology 18:207 (1996).
Kettleborough et al., *Eur J /mmunol* 24:952-958 (1994).
Kiem et al., Blood 83:1467-1473 (1994).
Kohler et al., *Eur J Immunol* 6:292 (1976).
Kohler et al., *Eur J Immunol* 6:511-519 (1976).
Kohler et al., *Nature* 256:495 (1975).
Kohler, Proc Natl Acad Sci USA 77:2197-2199 (1980).
Koller and Smithies, *Proc. Natl. Acad. Sci. USA* 86:8932-8935 (1989).
Kostelny et al., *J Immunol* 148:1547-53 (1992).
Kottis et al., *J Neurochem* 82:1566-1569 (2002).
Kozarsky and Wilson, *Curr Opin Genetics Devel* 3:499-503 (1993).
Kurtz, *FEES Letters*, 14a:105-108 (1982).
Lam, Nature 354:82-84 (1991).
Langer and Peppas, J., Macromol. Sci. Rev. Macromol. Chem. 23: pp. 61-126 (1983).
Langer, Science 249:1527-1535 (1990).
Langer, *supra*; Sefton, *CRC Cris Ref* Biomed Eng 14:201-241 (1987).
Lee et al., *Nature Rev Drug Discov* 2:872-879 (2003).
Levy et al., *Science* 228:190 (1985).
Liu et al., *Science* 297:1190-1193 (2002).
Loeffler and Behr, *Meth Enrymol* 217:599-718 (1993).
Logan & Shenk, *Proc Natl Acad Sci USA* 81:3655-59 (1984).
Lopez-Berestein, Ibid., pp. 317-327.
Lowy et al., *Cell* 22:8-17 (1980).
Marasco, *Gene Ther* 4:11-15 (1997).
Mastrangeli et al., J Clin. Invest 91:225-234 (1993).

Matsubara et al., Gold Sodium Thiomalate ("GST"; *J Clin Invest* 79:1440-1446, 1987).
May, *TIBTECH* /(5):155-215 (1993).
McCarty et al., Med Hypotheses 50(5):423-33 (1998).
McGonigle et al., *Kidney Ina*, 25:437-444 (1984).
McKerracher et al., *Neuron* 13:805-811 (1994).
Mendez et al., *Nature Genetics* 15:146-156 (1997).
Mi et al., Nat *Neurosci.* 7:221-228 (2004).
Miller et at.,*Meth Enzymol* 217:581-599 (1993).
Morgan and Anderson, *Ann Rev Biochem* 62:191-217 (1993).
Morrison, *Science* 229:1202 (1985).
Mulligan & Berg, *Proc Natl Acad Sci USA* 78:2072 (1981).
Mulligan, *Science* 260:926-932 (1993).
Murata et al., *Cancer Res.* 51:22-26, 1991).
Naramura et al., *Immunol Len* 39:91-99 (1994).
Naughton et al., *Acta Haemat* 69:171-179 (1983).
Noteborn et al., Mutat Res. 400(1-2):447-55 (1998).
Ohage and Steipe, *J Mol. Biol.* 291:1119-1128 (1999).
Ohage et al., *J Mol. Biol.* 291:1129-1134 (1999).
O'Hare et al., *Proc Nat! Acad Sci USA* 78:1527 (1981).
Oi et al., *Rio Techniques* 4:214 (1986).
Padlan, *Molecular Immunology* 28:489-498 (1991).
Patten et at., *Curr Opinion* Biotechnol 8:724-35 (1997).
Pavloff et al., *J Biol Chem* 267:17321-17326, 1992).
Pavlovic-Kantera, *Expt Hematol*, 8 (supp. 8) 283-291 (1980).
Pearson and Lipman, *Proc Nat! Acad Sci USA* 85:2444-8 (1988).
Perillo et al., J Mol Med 76(6):402-12 (1998).
Persic et al., *Gene* 187:9-18 (1997).
Posttranslational Covalent Modification of Proteins, B. C. Johnson, Ed., Academic Press, New York, pp. 1-12 (1983).
Powis et al., Chem Biol Interact 24;111-112:23-34 (1998).
Prinjha et al., *Nature* 403:383-384 (2000).
Proba et al., *JMoI Rio*/275:245-253 (1998).
Proudfoot, Nature 322:52 (1986).
Rattan et al., *Ann NYAcad Sci* 663:48-62 (1992).
Resegotti et al., *Panminerva Medico*, 23:243-248 (1981).
Riechmann et al., *Nature* 352:323 (1988).
Robinson et al., *T7B Tech* 11(5):155-2 (1993).
Roguska et al., *Proc Nat. Acad Sci USA* 91:969-973 (1994).
Ron et al. *J Biol Chem*, 268:2984-2988 (1993).
Rondon and Marasco, Ann *Rev Microbiol* 51:257-283 (1997).
Rosenfeld et al., *Cell* 68:143-155 (1992).
Rosenfeld et at., *Science* 252:431-434 (1991).
Rothman et al., *J Surg Oncol* 20:105-108 (1982).
Salmons and Gunzberg, *Human Gene Therapy* 4:129-141 (1993).
Santerre et al., *Gene* 30:147 (1984).
Saudek ct at., N Engl. J. Med. 321:574 (1989).
Schulze-Osthoff et al., *Eur J Biochem* 254(3):439-59 (1998).
Schwab and Caroni, *J Neurosci* 8:2381-2393 (1988).
Scott and Smith, Science 249:386-390 (1990).
Seifter et al., *Meth Enzymol* 182:626-646 (1990).
Shahidi, *New Eng JMed* 289:72-80 (1973).
Songsivilai & Lachman, *Clin Exp Immunol* 79:315-321 (1990).
Soria et al., *Targeted Diagn Ther* 7:193-212 (1992).
Storgard et al., J Clin Invest 103:47-54 (1999).
Studnicka et al., *Protein Engineering* 7:805-814 (1994).
Szybalska & Szybalski, *Proc Natl Acad Sci USA* 48:202 (1992).
Takahashi et al., Int Immunol 6:1567-1574 (1994).
Takeuchi et al., Agents Actions 36:312-316, (1992).
Tang et al., *Mo! Cell Neurosci* 18:259-269 (2001).
Thorpe et al., "Antibody Carriers of Cytotoxic Agents in Cancer Therapy: A Review", Monoclonal Antibodies 84: Biological and Clincial Applications, pp. 475-506 (1985).
Thorpe et al., *Immunol Rev* 62:119-58 (1982).
Tolstoshev, *Ann Rev Pharmacol Toxicol* 32:573-596 (1993).
Tomkinson et at,, *Biochem J* 286:475-480 (1992).
Torelli and Robotti, *Comput App! Biosci*/0 :3-5(1994).
Traunecker et al., "Bispecific single chain molecules (Janusins) target cytotoxic lymphocytes on HIV infected cells" *EMBO J.* 10:3655-3659 (1991).
Traunecker et al., "Janusin: new molecular design for bispecific reagents" *Int J Cancer Supp*17:51-52 (1992)).
Traunecker et al., *Nature* 331:84-86 (1988).

Treat et al., in Liposomes in the Therapy of Infectious Disease and Cancer, Lopez-Berestein and Fidler (eds.), Liss, New York, pp. 353-365 (1989).
Urabe et al., *J Exp Med* 149:1314-1325 (1979).
Van Heeke & Schuster, *Rio/ Chem* 24:5503-5509 (1989).
Vane et al., Int J Tissue React 20(1):3-15 (1998).
Walsh et al., *Proc Soc Exp Bio! Med* 204:289-300 (1993).
Wands et al. *Gastroenterology* 80:225-232 (1981).
Wang et al., *Gene Therapy* 2:775-783 (1995).
Wang et al., *Nature* 417:941-944 (2002).
Wang et al., *Nature* 420:74-78 (2002).
Watanabe et al., *J Biochem* 106:6977 (1989).
Wigler et al., *Cell* 11:223 (1977).
Wilson et al., *Cell* 37:767 (1984).
Wirtz and Steipe, *Protein Sci* 8:2245-2250 (1999).
Woolf, *Neuron* 38: 153-156 (2003).
Wu & Wu, *Biotherapy* 3:87-95 (1991).
Wu and Wu, *J Biol Chem* 262:4429-4432 (1987).
Zheng et al., *J Immunol* 154:5590-5600 (1995).

Zhu et al., *J Immunol. Methods* 231:207-222 (1999).
Zijlstra et at., *Nature* 342:435-438 (1989).
Zurflush et al., *Proc Natl. Acad Sci USA* 77:357 (1980).
European Supplemental Search Report for Application No. EP 05 74 4398.
Schnell et al., "Axonal Regeneration in the Rat Spinal Cord Produced by an Antibody Against Myelin-Associated Neurite growth Inhibitors," vol. 343, No. 6255, pp. 269-272.
Barton et al., "Structure and Axon Outgrowth Inhibitor Binding of the Nogo-66 Receptor and Related Proteins," *The EMBO Journ.*, vol. 22, No. 13, pp. 3291-3302 (2003).
Li et al., "A Neutralizing Anti-Nogo66 Receptor Monoclonal Antibody Reverses Inhibition of Neurite Outgrowth by Central Nervous System Myelin," *The Journ. Of Biol. Chem.*, vol. 279, No. 42 , pp. 43780-43788 (2004).
International Search Report for related International Application No. PCT/US05/10211.

\* cited by examiner

ANTIBODIES AGAINST NOGO RECEPTOR

CROSS-REFERENCE TO RELATED APPLICATIONS

This is application claims benefit under 35 U.S.C. §119(e) of U.S. provisional application No. 60/556,386, filed on Mar. 26, 2004, which is hereby incorporated by reference in its entirety.

FIELD OF THE INVENTION

The present invention relates to antibodies and related molecules that specifically bind to the Nogo receptor (NogoR). Such antibodies have uses, for example, in preventing Nogo, oligodendrocyte-myelin glycoprotein (OMgp), or myelin-associated glycoprotein (MAG) from binding to and/or activating NogoR. The invention also relates to nucleic acid molecules encoding anti-NogoR antibodies, vectors and host cells containing these nucleic acids, and methods for producing the same. The present invention relates to methods and compositions for treating or ameliorating spinal cord injury, brain trauma, paralysis, degenerative nervous system diseases, and stroke, comprising administering to an animal, preferably a human, an effective amount of one or more antibodies or fragments or variants thereof, or related molecules, that specifically bind to NogoR.

BACKGROUND OF THE INVENTION

Each year, thousands of individuals sustain spinal cord and/or brain injuries that result in motor dysfunction including partial or complete paralysis. Many of these injuries are the result of physical trauma, such as injuries sustained in vehicular accidents, violence and falls, while other injuries result from hereditary disorders such as multiple sclerosis or other medical conditions such as stroke.

Axons in the peripheral nervous system (PNS) vigorously regenerate after injury; however, severed axons in the CNS are unable to regenerate. The inability of adult CNS axons to regenerate is thought to be due to a combination of factors including: rapid death of injured neurons, intrinsically reduced capacity of adult neurons to grow when injured, lack of needed trophic molecules to support growth, and the presence of an environment that is non-permissive for growth (Woolf, Neuron 38: 153-156 (2003)). This hostile growth environment was further supported by the fact that adult CNS axons were capable of growing in a PNS-like environment (David and Aguayo Science, 214:931-933 (1981)), while PNS axons were still incapable of growing in a CNS environment (Schwab and Caroni, J Neurosci 8:2381-2393 (1988)).

One hypothesis for the difference in axonal regeneration observed in the PNS but not in the CNS is the presence of inhibitory molecules in CNS myelin sheath (Lee et al., Nature Rev Drug Discov 2:872-879 (2003)). The identification of several myelin-derived proteins which are preferentially expressed in the CNS supports this hypothesis. Nogo, OMgp, and MAG are all expressed in the CNS and have been demonstrated to inhibit neurite outgrowth (Chen et al., Nature 403:434-439 (2000); Grandpre et al., Nature 403:439-444 (2000); Prinjha et al., Nature 403:383-384 (2000); Mukhopadhyay et al., Neuron 13:805-811 (1994); Kottis et al., J Neurochem 82:1566-1569 (2002)). Each of these three inhibitors of axonal growth bind with high affinity to NogoR (Foumier et al., Nature 409:341-346 (2001); Domeniconi et al., Neuron 35:283-290 (2002); Wang et al., Nature 417:941-944 (2002)). NogoR is a glycosyl phosphatidylinositol-linked transmembrane protein and because of this, at least one other co-receptor must exist which can transduce signals initiated by ligand binding to NogoR (Foumier et al., J Neurosci 22:8876-8883 (2002); Hunt et al., J Neurocytol 31:93-120 (2002)). Both p75 and LINGO-1 have been identified as co-receptors of NogoR and function in inhibiting neurite outgrowth (Wong et al., Nature 420:74-78 (2002); Mi et al., Nat Neurosci 7:221-228 (2004)).

Since the interaction of Nogo, OMgp and MAG to the NogoR/p75/LINGO-1 receptor complex inhibits neurite outgrowth, researchers have focused their efforts in disrupting ligand binding to the receptor complex. Antibodies against Nogo have been used to overcome the inhibitory effect of Nogo (Domeniconi et al., Neuron 35:283-290 (2002)). Similarly, the neurite outgrowth inhibition of MAG was overcome using antibodies against MAG (Tang et al., Mol Cell Neurosci 18:259-269 (2001)). Efforts have been undertaken to neutralize NogoR-mediated signaling pathway. Antagonistic peptides against NogoR, soluble forms of NogoR, and antibodies against NogoR have been shown to promote axonal outgrowth in vitro and have thus identified NogoR as a potential therapeutic target for spinal cord injuries (Domeniconi et al., Neuron 35:283-290 (2002); Grandpre et al., Nature 417:547-551 (2002)). Compositions which prevent NogoR activity, either by preventing ligand binding or by preventing downstream signaling, would clearly be useful in combating spinal cord dysfunction.

As of today, there a few options available to treat or ameliorate the loss of motor/sensory function or paralysis associated with spinal cord injuries, stroke or multiple sclerosis. There is a clear need for the identification and characterization of compositions, such as antibodies, including fully human antibodies that bind NogoR and allow axonal/neurite outgrowth, as well as methods of treating or ameliorating paralysis using such compositions. In particular, there is a need for such compositions, methods of treating or ameliorating spinal cord injuries or stroke for use in humans.

SUMMARY OF THE INVENTION

The present invention encompasses antibodies (including molecules comprising, or alternatively consisting of, antibody fragments or variants thereof) that specifically bind to NogoR (SEQ ID NO:2) or polypeptide fragment or variant of NogoR. The NogoR polypeptide is also herein referred to as NogoR antigen or NogoR.

The present invention relates to methods and compositions for treating or ameliorating spinal cord injury, brain trauma, paralysis, degenerative nervous system diseases, and stroke, comprising administering to an animal, preferably a human, an effective amount of one or more antibodies or fragments or variants thereof, or related molecules, that specifically bind to the NogoR antigen, or a fragment or variant thereof. In specific embodiments, the present invention relates to methods and compositions for treating or ameliorating a disease or disorder associated with NogoR antigen function, comprising administering to an animal, preferably a human, an effective amount of one or more antibodies or fragments or variants thereof, or related molecules, that specifically bind the NogoR antigen, or a fragment or variant thereof.

In specific embodiments, antibodies of the invention are administered in combination with each other and/or other therapeutics or prophylactics such as a soluble NogoR, a soluble p75(NTR) receptor, a soluble LINGO-1 receptor, anti-NogoR antibodies, anti-p75(NTR) receptor antibodies or anti-LINGO-1 receptor antibodies. The p75(NTR) sequence (SEQ ID NO:6) is disclosed in Genbank Accession No. NP_002498 which is hereby incorporated by reference in its entirety. The LINGO-1 sequence (SEQ ID NO:7) is disclosed in Genbank Accession No. AAH11057 which is hereby incorporated by reference in its entirety. Additional therapeutics or prophylactics that may be administered in combination with antibodies of the invention include, but are not limited to, antibiotics, anti-inflammatories, growth factors, steroids, and stem cells.

Single chain Fv's (scFvs) that specifically bind the NogoR polypeptide (e.g., SEQ ID NOs:50-148) have been identified. Thus, the invention encompasses these scFvs, listed in Table 1. In addition, the invention encompasses cell lines engineered to express antibodies corresponding to these scFvs which are deposited with the American Type Culture Collection ("ATCC™") as of the dates listed in Table 1 and given the ATCC™ Deposit Numbers identified in Table 1. The ATCC™ is located at 10801 University Boulevard, Manassas, Va. 20110-2209, U.S.A. The ATCC™ deposit was made pursuant to the terms of the Budapest Treaty on the International Recognition of the Deposit of Microorganisms for Purposes of Patent Procedure.

Further, the present invention encompasses the polynucleotides encoding the scFvs, as well as the amino acid sequences encoding the scFvs. Molecules comprising, or alternatively consisting of, fragments or variants of these scFvs (e.g., VH domains, VH CDRs, VL domains, or VL CDRs having an amino acid sequence of any one of the scFvs referred to in Table 1), that specifically bind to the NogoR antigen, or fragments or variants thereof, are also encompassed by the invention, as are nucleic acid molecules that encode these antibodies and/or molecules.

In specific embodiments, antibodies of the invention promote neuronal and/or axonal regeneration caused by spinal cord injury. In other specific embodiments, antibodies of the invention prevent or ameliorate one or more symptoms associated with brain trauma, paralysis, degenerative nervous system diseases, and stroke.

In another embodiment, antibodies of the invention induce apoptotic cell death. In specific embodiments, antibodies of the invention inhibit the proliferation and/or induce apoptotic cell death of cancerous cells. In specific embodiments, antibodies of the invention inhibit the proliferation and/or induce apoptotic cell death of cancers of the CNS.

In specific embodiments, antibodies of the invention neutralize the ability of NogoR to form multimers. In another embodiment, antibodies of the invention neutralize the ability of NogoR to bind to a NogoR ligand, e.g., Nogo, OMgp, or MAG. The Nogo sequence (SEQ ID NO:3) is disclosed in Genbank Accession No. CAB99248 which is hereby incorporated by reference in its entirety. The OMgp sequence (SEQ ID NO:4) is disclosed in Genbank Accession No. NP_002535 which is hereby incorporated by reference in its entirety. The MAG sequence (SEQ ID NO:5) is disclosed in Genbank Accession No. NP_002352 which is hereby incorporated by reference in its entirety. In other embodiments, antibodies of the invention neutralize the ability of NogoR to interact with p75(NTR) and/or LINGO-1.

The present invention also provides antibodies that bind NogoR polypeptides which are coupled to a detectable label, such as an enzyme, a fluorescent label, a luminescent label, or a bioluminescent label. The present invention also provides antibodies that bind NogoR polypeptides which are coupled to a therapeutic or cytotoxic agent. The present invention also provides antibodies that bind NogoR polypeptides which are coupled to a radioactive material.

In further embodiments, the antibodies of the invention have a dissociation constant ($K_D$) of $10^{-7}$ M or less. In preferred embodiments, the antibodies of the invention have a dissociation constant ($K_D$) of $10^{-9}$ M or less.

In further embodiments, antibodies of the invention have an off rate ($k_{off}$) of $10^{-3}$/sec or less. In preferred embodiments, antibodies of the invention have an off rate ($k_{off}$) of $10^{-4}$/sec or less. In other preferred embodiments, antibodies of the invention have an off rate ($k_{off}$) of $10^{-5}$/sec or less.

The present invention also provides panels of antibodies (including molecules comprising, or alternatively consisting of, antibody fragments or variants) wherein the panel members correspond to one, two, three, four, five, ten, fifteen, twenty, or more different antibodies of the invention (e.g., whole antibodies, Fabs, F(ab')$_2$ fragments, Fd fragments, disulfide-linked Fvs (sdFvs), anti-idiotypic (anti-Id) antibodies, and scFvs). The present invention further provides mixtures of antibodies, wherein the mixture corresponds to one, two, three, four, five, ten, fifteen, twenty, or more different antibodies of the invention (e.g., whole antibodies, Fabs, F(ab')$_2$ fragments, Fd fragments, disulfide-linked Fvs (sdFvs), anti-idiotypic (anti-Id) antibodies, and scFvs). The present invention also provides for compositions comprising, or alternatively consisting of, one, two, three, four, five, ten, fifteen, twenty, or more antibodies of the present invention (including molecules comprising, or alternatively consisting of, antibody fragments or variants thereof). A composition of the invention may comprise, or alternatively consist of, one, two, three, four, five, ten, fifteen, twenty, or more amino acid sequences of one or more antibodies or fragments or variants thereof. Alternatively, a composition of the invention may comprise, or alternatively consist of, nucleic acid molecules encoding one or more antibodies of the invention.

The present invention also provides for fusion proteins comprising an antibody (including molecules comprising, or alternatively consisting of, antibody fragments or variants thereof) of the invention, and a heterologous polypeptide (i.e., a polypeptide unrelated to an antibody or antibody domain). Nucleic acid molecules encoding these fusion proteins are also encompassed by the invention. A composition of the present invention may comprise, or alternatively consist of, one, two, three, four, five, ten, fifteen, twenty or more fusion proteins of the invention. Alternatively, a composition of the invention may comprise, or alternatively consist of, nucleic acid molecules encoding one, two, three, four, five, ten, fifteen, twenty or more fusion proteins of the invention.

The present invention also provides for a nucleic acid molecule(s), generally isolated, encoding an antibody (including molecules such as scFvs, VH domains, or VL domains, that comprise, or alternatively consist of, an antibody fragment or variant thereof) of the invention. The present invention also provides a host cell transformed with a nucleic acid molecule of the invention and progeny thereof. The present invention also provides a method for the production of an antibody (including a molecule comprising, or alternatively consisting of, an antibody fragment or variant thereof) of the invention. The present invention further provides a method of expressing an antibody (including a molecule comprising, or alternatively consisting of, an antibody fragment or variant thereof) of the invention from a nucleic acid molecule. These and other aspects of the invention are described in further detail below.

DETAILED DESCRIPTION OF THE INVENTION

Definitions

The term "antibody," as used herein, refers to immunoglobulin molecules and immunologically active portions of immunoglobulin molecules, i.e., molecules that contain an antigen binding site that specifically binds an antigen. As such, the term antibody encompasses not only whole antibody molecules, but also antibody multimers and antibody fragments, as well as variants (including derivatives) of antibodies, antibody multimers and antibody fragments. Examples of molecules which are described by the term "antibody" herein include, but are not limited to: single chain Fvs (scFvs), Fab fragments, Fab' fragments, F(ab')$_2$, disulfide linked Fvs (sdFvs), Fvs, and fragments comprising or alternatively consisting of, either a VL or a VH domain. The term "single chain Fv" or "scFv" as used herein refers to a polypeptide comprising a VL domain of antibody linked to a VH domain of an antibody.

Antibodies of the invention include, but are not limited to, monoclonal, multispecific, human or chimeric antibodies, single chain antibodies, Fab fragments, F(ab') fragments, anti-idiotypic (anti-Id) antibodies (including, e.g. anti-Id antibodies to antibodies of the invention), intracellularly-made antibodies (i.e., intrabodies), and epitope-binding fragments of any of the above. The immunoglobulin molecules of the invention can be of any type (e.g., IgG, IgE, IgM, IgD, IgA and IgY), class (e.g., IgG$_1$, IgG$_2$, IgG$_3$, IgG$_4$, IgA$_1$ and IgA$_2$) or subclass of immunoglobulin molecule. Preferably, an antibody of the invention comprises, or alternatively consists of, a VH domain, VH CDR, VL domain, or VL CDR having an amino acid sequence of any one of those referred to in Table 1, or a fragment or variant thereof. In a preferred embodiment, the immunoglobulin is an IgG$_1$ isotype. In another preferred embodiment, the immunoglobulin is an IgG$_4$ isotype. Immunoglobulins may have both a heavy and light chain. An array of IgG, IgE, IgM, IgD, IgA, and IgY heavy chains may be paired with a light chain of the kappa or lambda forms.

Unless otherwise defined in the specification, specific binding by an antibody to NogoR means that an antibody binds NogoR but does not significantly bind to (i.e., cross react with) proteins other than NogoR, such as other proteins in the same family of proteins. An antibody that binds NogoR and does not cross-react with other proteins is not necessarily an antibody that does not bind said other proteins in all conditions; rather, NogoR-specific antibodies of the invention preferentially binds NogoR compared to its ability to bind said other proteins such that it will be suitable for use in at least one type of assay or treatment, i.e., give low background levels or result in no unreasonable adverse effects in treatment. It is well known that the portion of a protein bound by an antibody is known as the epitope. An epitope may either be linear (i.e., comprised of sequential amino acids residues in a protein sequences) or conformational (i.e., comprised of one or more amino acid residues that are not contiguous in the primary structure of the protein but that are brought together by the secondary, tertiary or quaternary structure of a protein). Given that NogoR-specific antibodies bind to epitopes of NogoR, an antibody that specifically binds NogoR may or may not bind fragments of NogoR and/or variants of NogoR (e.g., proteins that are at least 90% identical to NogoR) depending on the presence or absence of the epitope bound by a given NogoR-specific antibody in the NogoR fragment or variant. Additionally, NogoR-specific antibodies of the invention may bind modified forms of NogoR, e.g., NogoR fusion proteins. In such a case when antibodies of the invention bind NogoR fusion proteins, the antibody must make binding contact with the NogoR moiety of the fusion protein in order for the binding to be specific. Antibodies that specifically bind to NogoR can be identified, for example, by immunoassays or other techniques known to those of skill in the art, e.g., the immunoassays described in the Examples below.

Antibodies of the invention may also include multimeric form's of antibodies. For example, antibodies of the invention may take the form of antibody dimers, trimers, or higher-order multimers of monomeric immunoglobulin molecules. Dimers of whole immunoglobulin molecules or of F(ab')$_2$ fragments are tetravalent, whereas dimers of Fab fragments or scFv molecules are bivalent. Individual monomers within an antibody multimer may be identical or different, i.e., they may be heteromeric or homomeric antibody multimers. For example, individual antibodies within a multimer may have the same or different binding specificities. Multimerization of antibodies may be accomplished through natural aggregation of antibodies or through chemical or recombinant linking techniques known in the art. For example, some percentage of purified antibody preparations (e.g., purified IgG, molecules) spontaneously form protein aggregates containing antibody homodimers, and other higher-order antibody multimers. Alternatively, antibody homodimers may be formed through chemical linkage techniques known in the art. For example, heterobifunctional crosslinking agents including, but not limited to, SMCC [succinimidyl 4-(maleimidomethyl)cyclohexane-1-carboxylate] and SATA [N-succinimidyl S-acethylthio-acetate] (available, for example, from Pierce Biotechnology, Inc. (Rockford, Ill.)) can be used to form antibody multimers. An exemplary protocol for the formation of antibody homodimers is given in Ghetie et al., *Proc Natl Acad Sci USA* (1997) 94:7509-7514, which is hereby incorporated by reference in its entirety. Antibody homodimers can be converted to Fab'$_2$ homodimers through digestion with pepsin. Alternatively, antibodies can be made to multimerize through recombinant DNA techniques. IgM and IgA naturally form antibody multimers through the interaction with the J chain polypeptide. Non-IgA or non-IgM molecules, such as IgG molecules, can be engineered to contain the J chain interaction domain of IgA or IgM, thereby conferring the ability to form higher order multimers on the non-IgA or non-IgM molecules (see, for example, Chintalacharuvu et al., (2001) *Clin Immunol* 101:21-31 and Frigerio et al., *Plant Physiol* 123:1483-94 (2000), both of which are hereby incorporated by reference in their entireties). ScFv dimers can also be formed through recombinant techniques known in the art; an example of the construction of scFv dimers is given in Goel et al., *Cancer Res* 60:6964-6971 (2000), which is hereby incorporated by reference in its entirety. Antibody multimers may be purified using any suitable method known-in the art, including, but not limited to, size exclusion chromatography.

The term "variant" as used herein refers to a polypeptide that possesses a similar or identical function as the NogoR polypeptide, a fragment of the NogoR polypeptide, an anti-NogoR antibody or antibody fragment thereof, but does not necessarily comprise a similar or identical amino acid sequence of the NogoR polypeptide, a fragment of the NogoR polypeptide, an anti-NogoR antibody or antibody fragment thereof, or possess a similar or identical structure of the NogoR polypeptide, a fragment of the NogoR polypeptide, an anti-NogoR antibody or antibody fragment thereof, respectively. A variant having a similar amino acid sequence refers to a polypeptide that satisfies at least one of the following: (a) a polypeptide comprising, or alternatively consisting of, an amino acid sequence that is at least 30%, at least 35%, at least 40%, at least 45%, at least 50%, at least 55%, at least 60%, at least 65%, at least 70%, at least 75%, at least 80%, at least 85%, at least 90%, at least 95% or at least 99% identical to the amino acid sequence of the NogoR polypeptide (SEQ ID NO:2), a fragment of the NogoR polypeptide, an anti-NogoR antibody or antibody fragment thereof (including a VH domain, VHCDR, VL domain, or VLCDR having an amino acid sequence of any one or more scFvs referred to in Table 1) described herein; (b) a polypeptide encoded by a nucleotide sequence, the complementary sequence of which hybridizes under stringent conditions to a nucleotide sequence encoding NogoR (SEQ ID NO:1), a fragment of the NogoR polypeptide, an anti-NogoR antibody or antibody fragment thereof (including a VH domain, VHCDR, VL domain, or VLCDR having an amino acid sequence of any one of those referred to in Table 1), described herein, of at least 5 amino acid residues, at least 10 amino acid residues, at least 15 amino acid residues, at least 20 amino acid residues, at least 25 amino acid residues, at least 30 amino acid residues, at least 40 amino acid residues, at least 50 amino acid residues, at least 60 amino residues, at least 70 amino acid residues, at least 80 amino acid residues, at least 90 amino acid residues, at least 100 amino acid residues, at least 125 amino acid residues, or at least 150 amino acid residues; and (c) a polypeptide encoded by a nucleotide sequence that is at least 30%, at least 35%, at least 40%, at least 45%, at least 50%, at least 55%, at least 60%, at least 65%, at least 70%, at least 75%, at least 80%, at least 85%, at least 90%, at least 95% or at least 99%, identical to the nucleotide sequence encoding the NogoR polypeptide, a fragment of the NogoR polypeptide, an anti-NogoR antibody or antibody fragment thereof (including a VH domain, VHCDR, VL domain, or VLCDR having an amino acid sequence of any one or more scFvs referred to in Table 1), described herein. A polypeptide with similar structure to the NogoR polypeptide, a fragment of the NogoR polypeptide, an anti-NogoR antibody or antibody fragment thereof, described herein refers to a polypeptide that has a similar secondary, tertiary or quaternary structure of the NogoR polypeptide, a fragment of the NogoR polypeptide, an anti-NogoR antibody, or antibody fragment thereof, described herein. The structure of a polypeptide can determined by methods known to those skilled in the art, including but not limited to, X-ray crystallography, nuclear magnetic resonance, and crystallographic electron microscopy.

To determine the percent identity of two amino acid sequences or of two nucleic acid sequences, the sequences are aligned for optimal comparison purposes (e.g., gaps can be introduced in the sequence of a first amino acid or nucleic acid sequence for optimal alignment with a second amino acid or nucleic acid sequence). The amino acid residues or nucleotides at corresponding amino acid positions or nucleotide positions are then compared. When a position in the first sequence is occupied by the same amino acid residue or nucleotide at the corresponding position in the second sequence, then the molecules are identical at that position. The percent identity between the two sequences is a function of the number of identical positions shared by the sequences (i.e., % identity=number of identical overlapping positions/total number of positions×100%). In one embodiment, the two sequences are the same length.

The determination of percent identity between two sequences can be accomplished using a mathematical algorithm known to those of skill in the art. An example of a mathematical algorithm for comparing two sequences is the algorithm of Karlin and Altschul, Proc Natl Acad Sci USA 87:2264-2268 (1990), modified as in Karlin and Altschul, Proc Natl Acad Sci USA 90:5873-5877 (1993). The BLASTn and BLASTx programs of Altschul et al., J Mol Biol 215:403-410 (1990) have incorporated such an algorithm. BLAST nucleotide searches can be performed with the BLASTn program (score=100, wordlength=12) to obtain nucleotide sequences homologous to a nucleic acid molecules of the invention. BLAST protein searches can be performed with the BLASTx program (score=50, wordlength=3) to obtain amino acid sequences homologous to a protein molecules of the invention. To obtain gapped alignments for comparison purposes, Gapped BLAST can be utilized as described in Altschul et al., Nucleic Acids Res 25:3389-3402 (1997). Alternatively, PSI-BLAST can be used to perform an iterated search which detects distant relationships between molecules (Id.). When utilizing BLAST, Gapped BLAST, and PSI-BLAST programs, the default parameters of the respective programs (e.g., BLASTx and BLASTn) can be used. The various BLAST programs are available online through the National Center for Biotechnology Information web site.

Another example of a mathematical algorithm utilized for the comparison of sequences is the algorithm of Myers and Miller CABIOS (1989). The ALIGN program (version 2.0) which is part of the GCG sequence alignment software package has incorporated such an algorithm. Other algorithms for sequence analysis known in the art include ADVANCE and ADAM as described in Torellis and Robotti, *Comput Appl Biosci* 10:3-5(1994); and FASTA described in Pearson and Lipman, *Proc Natl Acad Sci USA* 85:2444-8 (1988). Within FASTA, ktup is a control option that sets the sensitivity and speed of the search.

The term "derivative" as used herein, refers to a variant polypeptide of the invention that comprises, or alternatively consists of, an amino acid sequence of the NogoR polypeptide, a fragment of the NogoR polypeptide, or an antibody of the invention that specifically binds to the NogoR polypeptide, which has been altered by the introduction of amino acid residue substitutions, deletions or additions. The term "derivative" as used herein also refers to the NogoR polypeptide, a fragment of the NogoR polypeptide, an antibody that specifically binds to the NogoR polypeptide which has been modified, e.g. by the covalent attachment of any type of molecule to the polypeptide. For example, but not by way of limitation, the NogoR polypeptide, a fragment of the NogoR polypeptide, or an anti-NogoR antibody, may be modified, e.g., by glycosylation, acetylation, pegylation, phosphorylation, amidation, derivatization by known protecting/blocking groups, proteolytic cleavage, linkage to a cellular ligand or other protein, etc. A derivative of the NogoR polypeptide, a fragment of the NogoR polypeptide, or an anti-NogoR antibody, may be modified by chemical modifications using techniques known to those of skill in the art, including, but not limited to, specific chemical cleavage, acetylation, formylation, metabolic synthesis of tunicamycin, etc. Further, a derivative of the NogoR polypeptide, a fragment of the NogoR polypeptide, or an anti-NogoR antibody, may contain one or more non-classical amino acids. A polypeptide derivative possesses a similar or identical function as the NogoR polypeptide, a fragment of the NogoR polypeptide, or an anti-NogoR antibody, described herein.

The term "epitopes" as used herein refers to portions of NogoR having antigenic or immunogenic activity in an animal, preferably a mammal. An epitope having immunogenic activity is a portion of NogoR that elicits an antibody response in an animal. An epitope having antigenic activity is a portion of NogoR to which an antibody specifically binds as determined by any method known in the art, for example, by the immunoassays described herein. Antigenic epitopes need not necessarily be immunogenic.

The term "fragment" as used herein refers to a polypeptide comprising an amino acid sequence of at least 5 amino acid residues, at least 10 amino acid residues, at least 15 amino acid residues, at least 20 amino acid residues, at least 25 amino acid residues, at least 30 amino acid residues, at least 35 amino acid residues, at least 40 amino acid residues, at least 45 amino acid residues, at least 50 amino acid residues, at least 60 amino residues, at least 70 amino acid residues, at least 80 amino acid residues, at least 90 amino acid residues, at least 100 amino acid residues, at least 125 amino acid residues, at least 150 amino acid residues, at least 175 amino acid residues, at least 200 amino acid residues, at least 250 amino acid residues, or at least 300 amino acid residues, of the amino acid sequence of NogoR or an anti-NogoR antibody (including molecules such as scFv's, that comprise, or alternatively consist of, antibody fragments or variants thereof) that specifically binds to NogoR.

The term "host cell" as used herein refers to the particular subject cell transfected with a nucleic acid molecule and the progeny or potential progeny of such a cell. Progeny may not be identical to the parent cell transfected with the nucleic acid molecule due to mutations or environmental influences that may occur in succeeding generations or integration of the nucleic acid molecule into the host cell genome.

Antibodies of the present invention are preferably provided in an isolated form, and preferably are substantially purified. By "isolated" is intended an antibody removed from its native environment. Thus, for example, an antibody produced and/or contained within a recombinant host cell is considered isolated for purposes of the present invention.

Antibody Structure

The basic antibody structural unit is known to comprise a tetramer. Each tetramer is composed of two identical pairs of polypeptide chains, each pair having one "light" (about 25 kilodalton) and one "heavy" chain (about 50-70 kilodalton). The amino-terminal portion of each chain includes a variable region of about 100 to 110 or more amino acids primarily responsible for antigen recognition. The carboxy-terminal portion of each chain defines a constant region primarily responsible for effector function. Human light chains are classified as kappa and lambda light chains. Heavy chains are classified as mu, delta, gamma, alpha, or epsilon, and define the antibody's isotype as IgM, IgD, IgG, IgA, and IgE, respectively. See generally, *Fundamental Immunology*, Ch. 7, Paul (ed.), 2nd ed., Raven Press, N.Y. (1989) (incorporated by reference in its entirety for all purposes). The variable regions of each light/heavy chain pair form the antibody binding site.

Thus, an intact IgG antibody has two binding sites. Except in bifunctional or bispecific antibodies, the two binding sites are the same.

The chains all exhibit the same general structure of relatively conserved framework regions (FR) joined by three hyper variable regions, also called complementarity determining regions or CDRs. The CDRs from the heavy and the light chains of each pair are aligned by the framework regions, enabling binding to a specific epitope. From N-terminal to C-terminal, both light and heavy chains comprise the domains FR1, CDR1, FR2, CDR2, FR3, CDR3 and FR4. The assignment of amino acids to each domain is in accordance with the definitions of Kabat *Sequences of Proteins of Immunological Interest* (National Institutes of Health, Bethesda, Md. (1987 and 1991)), Chothia & Lesk, *J Mol Biol* 196:901-917 (1987), or Chothia et al., *Nature* 342:878-883 (1989).

A bispecific or bifunctional antibody is an artificial hybrid antibody having two different heavy/light chain pairs and two different binding sites. Bispecific antibodies can be produced by a variety of methods including fusion of hybridomas or linking of Fab' fragments. See, e.g., Songsivilai & Lachmann, *Clin Exp Immunol* 79:315-321 (1990), Kostelny et al., *J Immunol* 148:1547-53 (1992). In addition, bispecific antibodies may be formed as "diabodies" (Holliger et al., "'Diabodies': small bivalent and bispecific antibody fragments" *Proc Natl Acad Sci USA* 90:6444-6448 (1993)) or "Janusins" (Traunecker et al., "Bispecific single chain molecules (Janusins) target cytotoxic lymphocytes on HIV infected cells" *EMBO J.* 10:3655-3659 (1991) and Traunecker et al., "Janusin: new molecular design for bispecific reagents" *Int J Cancer Suppl* 7:51-52 (1992)).

Production of bispecific antibodies can be a relatively labor intensive process compared with production of conventional antibodies and yields and degree of purity are generally lower for bispecific antibodies. Bispecific antibodies do not exist in the form of fragments having a single binding site (e.g., Fab, Fab', and Fv).

Anti-NogoR Antibodies

Using phage display technology, single chain antibody molecules ("scFvs") that specifically bind to NogoR (or fragments or variants thereof) have been identified (See Example 1). Molecules comprising, or alternatively consisting of, fragments or variants of these scFvs (e.g., including VH domains, VH CDRs, VL domains, or VL CDRs having an amino acid sequence of any one of those referred to in Table 1), that specifically bind to NogoR (or fragments or variants thereof) are also encompassed by the invention, as are nucleic acid molecules that encode these scFvs, and/or molecules.

In particular, the invention relates to scFvs that specifically bind to NogoR comprising, or alternatively consisting of, an amino acid sequence selected from the group consisting of SEQ ID NOs:50-148, as referred to in Table 1 below. Molecules comprising, or alternatively consisting of, fragments or variants of these scFvs (e.g., including VH domains, VH CDRs, VL domains, or VL CDRs having an amino acid sequence of any one of those referred to in Table 1), that specifically bind to NogoR are also encompassed by the invention, as are nucleic acid molecules that encode these scFvs, and/or molecules (e.g., SEQ ID NOs:149-247).

In specific embodiments, the invention provides antibodies corresponding to the scFvs referred to in Table 1. Such scFvs may routinely be "converted" to immunoglobulin molecules by inserting, for example, the nucleotide sequences encoding the VH and/or VL domains of the scFv into an expression vector containing the constant domain sequences and engineered to direct the expression of the immunoglobulin molecule, as described in more detail in Example 2 below.

NS0 cell lines that express IgG1 antibodies that comprise the VH and VL domains of scFvs of the invention have been deposited with the American Type Culture Collection ("ATCC™") on the dates listed in Table 1 and given the ATCC™ Deposit Numbers identified in Table 1. The ATCC™ is located at 10801 University Boulevard, Manassas, Va. 20110-2209, U.S.A. The ATCC™ deposit was made pursuant to the terms of the Budapest Treaty on the International Recognition of the Deposit of Microorganisms for Purposes of Patent Procedure.

Accordingly, in one embodiment, the invention provides antibodies that comprise the VH and VL domains of scFvs of the invention.

TABLE 1

Anti-NogoR scFvs

| ScFv | scFv protein SEQ ID NO: | scFv DNA SEQ ID NO: | AAs of VH Domain | AAs of VH CDR1 | AAs of VH CDR2 | AAs of VH CDR3 | AAs of VL Domain | AAs of VL CDR1 | AAs of VL CDR2 | AAs of VL CDR3 | Cell Line Expressing antibody | ATCC™ Deposit Number | ATCC™ Deposit Date |
|---|---|---|---|---|---|---|---|---|---|---|---|---|---|
| NGE2005 | 50 | 149 | 1-118 | 31-35 | 50-66 | 99-107 | 133-241 | 155-165 | 181-187 | 220-230 | | | |
| NGE2077 | 51 | 150 | 1-122 | 31-35 | 50-66 | 99-111 | 138-248 | 160-172 | 188-194 | 227-237 | | | |
| NGE2105 | 52 | 151 | 1-121 | 31-35 | 50-65 | 98-110 | 137-247 | 159-172 | 188-194 | 227-236 | | | |
| NGE2122 | 53 | 152 | 1-124 | 31-35 | 50-66 | 99-113 | 140-250 | 162-175 | 191-197 | 230-239 | | | |
| NGE2902 | 54 | 153 | 1-129 | 31-35 | 50-66 | 99-118 | 145-255 | 167-180 | 196-202 | 235-244 | | | |
| NGE2925 | 55 | 154 | 1-116 | 31-36 | 51-66 | 99-105 | 131-239 | 153-163 | 179-185 | 218-228 | | | |
| NGE3064 | 56 | 155 | 1-124 | 31-35 | 50-66 | 99-113 | 140-250 | 162-175 | 191-197 | 230-239 | | | |
| NGF0540 | 57 | 156 | 1-128 | 31-37 | 52-67 | 100-117 | 146-256 | 168-180 | 196-202 | 235-245 | | | |
| NGF0719 | 58 | 157 | 1-120 | 31-35 | 50-66 | 99-109 | 137-247 | 159-171 | 187-193 | 226-236 | | | |
| NGF0936 | 59 | 158 | 1-127 | 31-35 | 50-66 | 99-116 | 144-254 | 166-178 | 194-200 | 233-243 | | | |
| NGF0947 | 60 | 159 | 1-120 | 31-35 | 50-66 | 99-109 | 137-248 | 159-172 | 188-194 | 227-237 | | | |
| NGF1A04 | 61 | 160 | 1-127 | 31-35 | 50-66 | 99-116 | 145-255 | 167-179 | 195-201 | 234-244 | | | |
| NGF1C04 | 62 | 161 | 1-127 | 31-37 | 52-67 | 100-116 | 144-254 | 166-178 | 194-200 | 233-243 | | | |
| NGF1E07 | 63 | 162 | 1-119 | 31-35 | 50-66 | 99-108 | 137-245 | 159-169 | 185-191 | 224-234 | | | |
| NGF1G12 | 64 | 163 | 1-122 | 31-35 | 50-66 | 99-111 | 140-250 | 162-174 | 190-196 | 229-239 | | | |
| NGF3C10 | 65 | 164 | 1-121 | 31-36 | 51-66 | 99-110 | 138-249 | 160-173 | 189-195 | 228-238 | | | |
| NGG2208 | 66 | 165 | 1-131 | 31-35 | 50-66 | 99-120 | 149-256 | 172-182 | 198-204 | 237-245 | | | |
| NGE2001 | 67 | 166 | 1-123 | 31-35 | 50-66 | 99-112 | 139-246 | 162-172 | 188-194 | 227-235 | | | |
| NGE2014 | 68 | 167 | 1-123 | 31-35 | 50-66 | 99-112 | 139-249 | 161-174 | 190-196 | 229-238 | | | |
| NGE2061 | 69 | 168 | 1-121 | 31-37 | 52-69 | 102-111 | 137-244 | 160-170 | 186-192 | 225-233 | | | |
| NGE2072 | 70 | 169 | 1-120 | 31-35 | 49-65 | 98-109 | 136-246 | 158-171 | 187-193 | 226-235 | | | |
| NGE2108 | 71 | 170 | 1-123 | 31-35 | 50-66 | 99-112 | 139-249 | 161-174 | 190-196 | 229-238 | | | |
| NGE2131 | 72 | 171 | 1-124 | 31-37 | 52-67 | 100-113 | 140-247 | 163-173 | 189-195 | 228-236 | | | |
| NGE2132 | 73 | 172 | 1-121 | 30-34 | 49-65 | 98-110 | 137-247 | 159-172 | 188-194 | 227-236 | | | |
| NGE2258 | 74 | 173 | 1-127 | 31-35 | 50-66 | 99-116 | 143-250 | 166-175 | 192-198 | 231-239 | | | |
| NGE2281 | 75 | 174 | 1-124 | 31-35 | 50-66 | 99-113 | 140-250 | 162-175 | 191-197 | 230-239 | | | |
| NGE2433 | 76 | 175 | 1-117 | 31-35 | 50-65 | 98-106 | 133-243 | 155-168 | 184-190 | 223-232 | | | |
| NGE2435 | 77 | 176 | 1-123 | 31-35 | 50-66 | 99-112 | 139-249 | 161-174 | 190-196 | 229-238 | | | |
| NGE2439 | 78 | 177 | 1-116 | 31-36 | 51-66 | 99-105 | 131-239 | 153-163 | 179-185 | 218-228 | | | |
| NGE2445 | 79 | 178 | 1-132 | 31-35 | 50-66 | 99-121 | 147-255 | 169-179 | 195-201 | 234-244 | | | |
| NGE2446 | 80 | 179 | 1-123 | 31-35 | 50-66 | 99-112 | 139-249 | 161-174 | 190-196 | 229-238 | | | |
| NGE2447 | 81 | 180 | 1-115 | 31-35 | 50-65 | 98-104 | 130-238 | 152-162 | 178-184 | 217-227 | | | |
| NGE2458 | 82 | 181 | 1-127 | 31-35 | 50-66 | 99-116 | 143-250 | 166-176 | 192-198 | 231-239 | | | |
| NGE2506 | 83 | 182 | 1-122 | 31-35 | 50-66 | 99-111 | 137-245 | 159-169 | 185-191 | 224-234 | | | |
| NGE2527 | 84 | 183 | 1-124 | 31-35 | 50-66 | 99-113 | 140-250 | 162-174 | 190-196 | 229-239 | | | |
| NGE2595 | 85 | 184 | 1-123 | 31-35 | 50-66 | 99-112 | 139-249 | 161-174 | 190-196 | 229-238 | | | |
| NGE2634 | 86 | 185 | 1-121 | 31-35 | 50-66 | 99-110 | 137-244 | 160-170 | 186-192 | 225-233 | | | |
| NGE2638 | 87 | 186 | 1-127 | 31-35 | 50-66 | 99-116 | 143-250 | 166-176 | 192-198 | 231-239 | | | |
| | 88 | 187 | 1-116 | 31-35 | 50-66 | 99-105 | 132-242 | 154-166 | 182-188 | 221-231 | | | |

TABLE 1-continued

Anti-NogoR scFvs

| ScFv | scFv protein SEQ ID NO: | scFv DNA SEQ ID NO: | AAs of VH Domain | AAs of VH CDR1 | AAs of VH CDR2 | AAs of VH CDR3 | AAs of VL Domain | AAs of VL CDR1 | AAs of VL CDR2 | AAs of VL CDR3 | Cell Line Expressing antibody | ATCC™ Deposit Number | ATCC™ Deposit Date |
|---|---|---|---|---|---|---|---|---|---|---|---|---|---|
| NGE2648 | 89 | 188 | 1-119 | 31-35 | 50-68 | 101-108 | 135-242 | 158-168 | 184-190 | 223-231 | | | |
| NGE2741 | 90 | 189 | 1-121 | 31-35 | 50-66 | 99-110 | 137-244 | 160-170 | 186-192 | 225-233 | | | |
| NGE2775 | 91 | 190 | 1-123 | 31-35 | 50-66 | 99-112 | 139-249 | 161-174 | 190-196 | 229-238 | | | |
| NGE2868 | 92 | 191 | 1-125 | 31-35 | 50-66 | 99-114 | 141-251 | 163-176 | 192-198 | 231-240 | | | |
| NGE2889 | 93 | 192 | 1-119 | 31-35 | 50-66 | 99-108 | 135-242 | 158-168 | 184-190 | 223-231 | | | |
| NGE2927 | 94 | 193 | 1-128 | 31-35 | 50-66 | 99-117 | 144-255 | 166-178 | 194-200 | 233-244 | | | |
| NGE2938 | 95 | 194 | 1-127 | 31-37 | 52-67 | 99-117 | 143-253 | 165-178 | 194-200 | 233-242 | | | |
| NGE2967 | 96 | 195 | 1-115 | 31-35 | 50-65 | 98-104 | 130-238 | 152-162 | 178-184 | 217-227 | | | |
| NGE2968 | 97 | 196 | 1-123 | 31-35 | 50-66 | 99-112 | 139-249 | 161-173 | 189-195 | 228-238 | | | |
| NGE2988 | 98 | 197 | 1-124 | 31-37 | 52-67 | 99-113 | 140-250 | 162-175 | 191-197 | 230-239 | | | |
| NGE3006 | 99 | 198 | 1-122 | 31-35 | 50-66 | 99-111 | 137-244 | 159-169 | 185-191 | 224-233 | | | |
| NGE3027 | 100 | 199 | 1-127 | 31-35 | 50-68 | 101-116 | 142-250 | 164-174 | 190-196 | 229-239 | | | |
| NGE3040 | 101 | 200 | 1-118 | 31-35 | 50-66 | 99-107 | 134-241 | 157-167 | 183-189 | 222-230 | | | |
| NGE3102 | 102 | 201 | 1-123 | 31-35 | 50-66 | 99-112 | 139-249 | 161-174 | 190-196 | 229-238 | | | |
| NGE3181 | 103 | 202 | 1-115 | 31-35 | 50-65 | 98-104 | 130-238 | 152-162 | 178-184 | 217-227 | | | |
| NGF0502 | 104 | 203 | 1-128 | 31-37 | 52-67 | 100-117 | 146-258 | 169-185 | 201-207 | 240-247 | | | |
| NGF0503 | 105 | 204 | 1-124 | 31-35 | 50-66 | 99-113 | 142-249 | 165-175 | 191-197 | 230-238 | | | |
| NGF0532 | 106 | 205 | 1-121 | 31-35 | 50-66 | 99-110 | 138-248 | 160-173 | 189-195 | 228-237 | | | |
| NGF0577 | 107 | 206 | 1-125 | 31-35 | 50-66 | 99-114 | 142-254 | 164-177 | 193-199 | 232-243 | | | |
| NGF0746 | 108 | 207 | 1-132 | 30-34 | 51-67 | 100-121 | 150-259 | 173-184 | 200-206 | 239-248 | | | |
| NGF0770 | 109 | 208 | 1-123 | 31-35 | 50-66 | 99-116 | 144-253 | 166-179 | 195-201 | 234-242 | | | |
| NGF0788 | 110 | 209 | 1-121 | 31-35 | 50-66 | 99-110 | 138-248 | 160-173 | 189-195 | 228-237 | | | |
| NGF0808 | 111 | 210 | 1-121 | 31-35 | 50-66 | 99-110 | 138-248 | 160-172 | 188-194 | 227-237 | | | |
| NGF0825 | 112 | 211 | 1-135 | 31-37 | 52-67 | 100-124 | 153-260 | 176-187 | 203-209 | 242-249 | | | |
| NGF0954 | 113 | 212 | 1-118 | 31-35 | 50-65 | 98-107 | 136-244 | 159-169 | 185-191 | 224-233 | | | |
| NGF1A05 | 114 | 213 | 1-128 | 31-35 | 50-66 | 99-117 | 146-259 | 169-185 | 201-207 | 240-248 | | | |
| NGF1B02 | 115 | 214 | 1-127 | 31-35 | 50-66 | 99-116 | 144-254 | 166-178 | 194-200 | 233-243 | | | |
| NGF1B03 | 116 | 215 | 1-128 | 31-35 | 50-66 | 99-117 | 145-255 | 167-179 | 195-201 | 234-244 | | | |
| NGF1B09 | 117 | 216 | 1-123 | 31-35 | 50-66 | 99-112 | 140-250 | 162-174 | 190-196 | 229-239 | | | |
| NGF1C10 | 118 | 217 | 1-123 | 31-35 | 50-66 | 99-112 | 140-252 | 162-175 | 191-197 | 230-241 | | | |
| NGF1D09 | 119 | 218 | 1-122 | 31-37 | 52-67 | 100-111 | 139-249 | 161-173 | 189-195 | 228-238 | | | |
| NGF1E09 | 120 | 219 | 1-120 | 31-35 | 50-66 | 99-109 | 137-247 | 159-172 | 188-194 | 227-236 | | | |
| NGF1G03 | 121 | 220 | 1-123 | 31-35 | 50-66 | 100-112 | 140-250 | 162-174 | 190-196 | 229-239 | | | |
| NGF1H02 | 122 | 221 | 1-127 | 31-37 | 52-67 | 101-116 | 144-256 | 166-179 | 195-201 | 234-245 | | | |
| NGF1H06 | 123 | 222 | 1-116 | 31-35 | 50-65 | 98-105 | 133-241 | 155-165 | 181-187 | 220-230 | | | |
| NGF2C06 | 124 | 223 | 1-128 | 31-35 | 50-66 | 99-117 | 145-256 | 167-180 | 196-202 | 235-245 | | | |
| NGF2D02 | 125 | 224 | 1-124 | 31-35 | 50-66 | 99-113 | 141-253 | 163-176 | 192-198 | 231-242 | | | |
| NGF2D08 | 126 | 225 | 1-126 | 31-36 | 51-66 | 99-115 | 143-258 | 165-178 | 194-204 | 239-247 | | | |
| NGF2E08 | 127 | 226 | 1-128 | 31-36 | 51-66 | 99-117 | 146-258 | 169-184 | 200-206 | 239-247 | | | |
| NGF2E11 | 128 | 227 | 1-120 | 31-35 | 50-66 | 99-109 | 137-245 | 159-169 | 185-191 | 224-234 | | | |
| NGF2F11 | 129 | 228 | 1-120 | 31-35 | 50-66 | 99-109 | 137-247 | 159-171 | 187-193 | 226-236 | | | |
| NGF2G02 | 130 | 229 | 1-127 | 31-35 | 50-66 | 99-116 | 144-254 | 166-178 | 194-200 | 233-243 | | | |
| NGF2G10 | 131 | 230 | 1-126 | 31-35 | 50-66 | 99-115 | 143-255 | 165-178 | 194-200 | 233-244 | | | |

TABLE 1-continued

Anti-NogoR scFvs

| ScFv | scFv protein SEQ ID NO: | scFv DNA SEQ ID NO: | AAs of VH Domain | AAs of VH CDR1 | AAs of VH CDR2 | AAs of VH CDR3 | AAs of VL Domain | AAs of VL CDR1 | AAs of VL CDR2 | AAs of VL CDR3 | Cell Line Expressing antibody | ATCC™ Deposit Number | ATCC™ Deposit Date |
|---|---|---|---|---|---|---|---|---|---|---|---|---|---|
| NGF3B08 | 132 | 231 | 1-121 | 31-35 | 50-66 | 99-110 | 138-249 | 160-173 | 189-195 | 228-238 | | | |
| NGF3D11 | 133 | 232 | 1-122 | 31-35 | 50-66 | 99-111 | 139-249 | 161-173 | 189-195 | 228-238 | | | |
| NGF3H03 | 134 | 233 | 1-121 | 31-35 | 50-66 | 99-110 | 139-250 | 161-173 | 189-195 | 230-239 | | | |
| NGG2002 | 135 | 234 | 1-126 | 31-35 | 50-66 | 99-115 | 143-253 | 165-177 | 193-199 | 232-242 | | | |
| NGG2004 | 136 | 235 | 1-122 | 31-35 | 50-66 | 99-111 | 139-250 | 161-174 | 190-196 | 229-239 | | | |
| NGG2007 | 137 | 236 | 1-119 | 31-35 | 50-66 | 99-108 | 137-245 | 159-169 | 185-191 | 224-234 | | | |
| NGG2017 | 138 | 237 | 1-122 | 31-35 | 50-66 | 99-111 | 140-247 | 162-172 | 188-194 | 227-236 | | | |
| NGG2022 | 139 | 238 | 1-128 | 31-35 | 50-66 | 99-117 | 145-255 | 167-179 | 195-201 | 234-244 | | | |
| NGG2043 | 140 | 239 | 1-128 | 31-35 | 50-66 | 99-117 | 145-256 | 167-180 | 196-202 | 235-245 | | | |
| NGG2051 | 141 | 240 | 1-119 | 31-35 | 50-66 | 99-108 | 137-247 | 159-171 | 187-193 | 228-236 | | | |
| NGG2053 | 142 | 241 | 1-118 | 31-35 | 50-66 | 99-107 | 136-244 | 158-168 | 184-190 | 223-233 | | | |
| NGG2071 | 143 | 242 | 1-128 | 31-35 | 50-66 | 99-117 | 145-255 | 167-180 | 196-202 | 235-244 | | | |
| NGG2086 | 144 | 243 | 1-120 | 31-35 | 50-66 | 99-109 | 138-246 | 160-170 | 186-192 | 225-235 | | | |
| NGG2103 | 145 | 244 | 1-119 | 31-35 | 50-66 | 99-108 | 136-246 | 158-170 | 186-192 | 225-235 | | | |
| NGG2105 | 146 | 245 | 1-122 | 31-35 | 50-66 | 99-111 | 140-247 | 162-172 | 188-194 | 227-236 | | | |
| NGG2123 | 147 | 246 | 1-118 | 31-35 | 50-66 | 99-107 | 135-244 | 157-167 | 183-189 | 222-233 | | | |
| NGG2251 | 148 | 247 | 1-125 | 31-35 | 50-66 | 99-114 | 142-253 | 164-177 | 193-199 | 232-242 | | | |
| NGF3C11 | 248 | 249 | 1-121 | 31-36 | 51-66 | 99-110 | 138-249 | 160-173 | 189-195 | 228-238 | | | |

The present invention encompasses antibodies (including molecules comprising, or alternatively consisting of, antibody fragments or variants thereof) that specifically bind to a NogoR polypeptide or a fragment, variant, or fusion protein thereof. A NogoR polypeptide includes, but is not limited to, the polypeptide of SEQ ID NO:2.

NogoR Antigen

Antibodies of the present invention bind the NogoR polypeptide, or fragments or variants thereof. The following section describes the NogoR polypeptides, fragments and variants that may be bound by the antibodies of the invention in more detail.

The NogoR protein is a 473 amino acid protein (SEQ ID NO:2) comprising a signal sequence, a leucine-rich repeat (LRR) type N-terminal domain (PFAM Accession number PF01462), eight LRR domains (PFAM Accession number PF00560), a cysteine-rich LRR-type C-terminal flanking domain (PFAM Accession number PF01463), a unique C-terminal region and a glycophosphatidylinositol (GPI)-anchorage site (Fournier et al., *J Neurosci* 22:8876-8883, (2002)). The signal sequence of Nogo R is predicted to be amino acids 1 through 26 of SEQ ID NO:2; the LRR-type N terminal domain can be found from about amino acid 27 through amino acid 57 of SEQ ID NO:2; the eight LRR domains are found at amino acids 58 to 81 of SEQ ID NO:2 (LRR1), 82 to 105 of SEQ ID NO:2 (LRR2), 106 to 130 of SEQ ID NO:2 (LRR3), 131 to 154 of SEQ ID NO:2 (LRR4), 155 to 178 of SEQ ID NO:2 (LRR5), 179 to 202 of SEQ ID NO:2 (LRR6), 203 to 226 of SEQ ID NO:2 (LRR7), and 227 to 250 of SEQ ID NO:2 (LRR8); and the LRR-type C terminal domain resides n the region from about amino acid 260 through amino acid 310 of SEQ ID NO:2. It will be understood by one of skill in the art that the exact "address" of the LRR domains (including the N and C terminal LRR domains) of NogoR may vary slightly (e.g., the address may "shift" by about 1 to about 20 residues, more likely about 1 to about 5 residues) depending on the criteria used to define the domain. All known ligands for NogoR bind to the LRR domains of NogoR (Liu et al., *Science* 297:1190-1193 (2002); Wang et al., *Nature* 417:941-944 (2002); Fournier et al., *J Neurosci* 22:8876-8883, (2002); Wang et al., *Nature* 420:74-78 (2002)).

Thus, in specific embodiments, antibodies of the invention may bind the full length 473 amino acid form of NogoR, and/or polypeptides that comprise or alternatively consist of one or more of the LRR domains of the NogoR protein. Antibodies of the invention may also bind a soluble form of NogoR.

In certain embodiments, the antibodies of the present invention specifically bind the NogoR polypeptide. An antibody that specifically binds NogoR may, in some embodiments, bind fragments, variants (including species orthologs of NogoR), multimers or modified forms of NogoR. For example, an antibody specific for NogoR may bind the NogoR moiety of a fusion protein comprising all or a portion of NogoR.

NogoR proteins may be found as monomers or multimers (i.e., dimers, trimers, tetramers, and higher multimers). Accordingly, the present invention relates to antibodies that bind NogoR proteins found as monomers or as part of multimers. In specific embodiments, antibodies of the invention bind NogoR monomers, dimers, trimers or multimers. In additional embodiments, antibodies of the invention bind at least dimers, at least trimers, or at least tetramers containing one or more NogoR polypeptides.

Antibodies of the invention may bind NogoR homomers or heteromers. As used herein, the term homomer, refers to a multimer containing only NogoR proteins of the invention (including NogoR fragments, variants, and fusion proteins, as described herein). These homomers may contain NogoR proteins having identical or different polypeptide sequences. In a specific embodiment, a homomer of the invention is a multimer containing only NogoR proteins having an identical polypeptide sequence. In another specific embodiment, antibodies of the invention bind NogoR homomers containing NogoR proteins having different polypeptide sequences. In specific embodiments, antibodies of the invention bind a NogoR homodimer (e.g., containing NogoR proteins having identical or different polypeptide sequences). In additional embodiments, antibodies of the invention bind at least a homodimer, at least a homotrimer, or at least a homotetramer of NogoR.

As used herein, the term heteromer refers to a multimer containing heterologous proteins (i.e., proteins containing polypeptide sequences that do not correspond to a polypeptide sequences encoded by the NogoR gene) in addition to the NogoR proteins of the invention. In a specific embodiment, antibodies of the invention bind a heterodimer, a heterotrimer, or a heterotetramer. In additional embodiments, the antibodies of the invention bind at least a heterodimer, at least a heterotrimer, or at least a heterotetramer containing one or more NogoR polypeptides.

Multimers bound by one or more antibodies of the invention may be the result of hydrophobic, hydrophilic, ionic and/or covalent associations and/or may be indirectly linked, by for example, liposome formation. Thus, in one embodiment, antibodies of the invention may bind NogoR multimers that are formed when NogoR proteins contact one another in solution. In another embodiment, antibodies of the invention may bind heteromultimers that are formed when proteins of the invention contact antibodies to the NogoR polypeptides (including antibodies to the heterologous polypeptide sequence in a fusion protein) in solution. In other embodiments, multimers bound by one or more antibodies of the invention are formed by covalent associations with and/or between the NogoR proteins of the invention. Such covalent associations may involve one or more amino acid residues contained in the polypeptide sequence of the protein (e.g., the polypeptide sequence recited in SEQ ID NO:2). In one instance, the covalent associations are cross-linking between cysteine residues located within the polypeptide sequences of the proteins which interact in the native (i.e., naturally occurring) polypeptide. In another instance, the covalent associations are the consequence of chemical or recombinant manipulation. Alternatively, such covalent associations may involve one or more amino acid residues contained in the heterologous polypeptide sequence in a NogoR fusion protein. In one example, covalent associations are between the heterologous sequence contained in a fusion protein (see, e.g., U.S. Pat. No. 5,478,925). In a specific example, the covalent associations are between heterologous sequences contained in NogoR-Fc or NogoR-human serum albumin (NogoR-HSA) fusion proteins (as described herein).

The multimers that antibodies of the invention may bind can be generated using chemical techniques known in the art. For example, proteins desired to be contained in the multimers of the invention may be chemically cross-linked using linker molecules and linker molecule length optimization techniques known in the art (see, e.g., U.S. Pat. No. 5,478,925, which is herein incorporated by reference in its entirety). Additionally, multimers that antibodies of the invention may bind can be generated using techniques known in the art to form one or more inter-molecule cross-links between the cysteine residues located within the polypeptide sequence of the proteins desired to be contained in the multimer (see, e.g., U.S. Pat. No. 5,478,925, which is herein incorporated by reference in its entirety). Further, proteins that antibodies of the invention may bind can be routinely modified by the addition of cysteine or biotin to the C terminus or N-terminus of the polypeptide sequence of the protein and techniques known in the art may be applied to generate multimers containing one or more of these modified proteins (see, e.g., U.S. Pat. No. 5,478,925, which is herein incorporated by reference in its entirety). Additionally, techniques known in the art may be applied to generate liposomes containing the protein components desired to be contained in the multimer that may be bound by one or more antibodies of the invention (see, e.g., U.S. Pat. No. 5,478,925, which is herein incorporated by reference in its entirety).

Alternatively, multimers that antibodies of the invention may bind can be generated using genetic engineering techniques known in the art. In one embodiment, proteins contained in multimers that may be bound by one or more antibodies of the invention are produced recombinantly using fusion protein technology described herein or otherwise known in the art (see, e.g., U.S. Pat. No. 5,478,925, which is herein incorporated by reference in its entirety). In a specific embodiment, polynucleotides coding for a homodimer that may be bound by one or more antibodies of the invention are generated by ligating a polynucleotide sequence encoding a NogoR polypeptide to a sequence encoding a linker polypeptide and then further to a synthetic polynucleotide encoding the translated product of the polypeptide in the reverse orientation from the original C-terminus to the N-terminus (lacking the leader sequence) (see, e.g., U.S. Pat. No. 5,478,925, which is herein incorporated by reference in its entirety). In another embodiment, recombinant techniques described herein or otherwise known in the art are applied to generate recombinant NogoR polypeptides which contain a transmembrane domain and which can be incorporated by membrane reconstitution techniques into liposomes (see, e.g., U.S. Pat. No. 5,478,925, which is herein incorporated by reference in its entirety). In another embodiment, two or more NogoR polypeptides are joined through synthetic linkers (e.g., peptide, carbohydrate or soluble polymer linkers). Examples include those peptide linkers described in U.S. Pat. No. 5,073,627 (hereby incorporated by reference). Proteins comprising multiple NogoR polypeptides separated by peptide linkers may be produced using conventional recombinant DNA technology. In specific embodiments, antibodies of the invention bind proteins comprising multiple NogoR polypeptides separated by peptide linkers.

Another method for preparing multimer NogoR polypeptides involves use of NogoR polypeptides fused to a leucine zipper or isoleucine polypeptide sequence. Leucine zipper domains and isoleucine zipper domains are polypeptides that promote multimerization of the proteins in which they are found. Leucine zippers were originally identified in several DNA-binding proteins (Landschulz et al., Science 240:1759, (1988)), and have since been found in a variety of different proteins. Among the known leucine zippers are naturally occurring peptides and derivatives thereof that dimerize or trimerize. Examples of leucine zipper domains suitable for producing soluble multimeric NogoR proteins are those described in PCT application WO 94/10308, hereby incorporated by reference. Recombinant fusion proteins comprising a soluble NogoR polypeptide fused to a peptide that dimerizes or trimerizes in solution are expressed in suitable host cells, and the resulting soluble multimeric NogoR is recovered from the culture supernatant using techniques known in the art. In specific embodiments, antibodies of the invention bind NogoR-leucine zipper fusion protein monomers and/or NogoR-leucine zipper fusion protein multimers.

Antibodies that bind NogoR receptor polypeptides may bind them as isolated polypeptides or in their naturally occurring state. By "isolated polypeptide" is intended a polypeptide removed from its native environment. Thus, a polypeptide produced and/or contained within a recombinant host cell is considered isolated for purposes of the present invention. Also intended as an "isolated polypeptide" are polypeptides that have been purified, partially or substantially, from a recombinant host cell. For example, a recombinantly produced version of the NogoR polypeptide may be substantially purified by the one-step method described in Smith and Johnson, Gene 67:31-40 (1988). Thus, antibodies of the present invention may bind recombinantly produced NogoR polypeptides. In a specific embodiment, antibodies of the present invention bind NogoR secreted by a cell, preferably a bacterial cell, comprising a polynucleotide encoding amino acids 1 to 473 of SEQ ID NO:2 operably associated with a regulatory sequence that controls gene expression. In other specific embodiments, antibodies of the present invention bind a NogoR polypeptide expressed secreted by a cell comprising a polynucleotide encoding amino acids 27 to 476 of SEQ ID NO:2 operably associated with a regulatory sequence that controls gene expression.

Antibodies of the present invention that may bind NogoR polypeptide fragments comprising or alternatively, consisting of, an amino acid sequence contained in SEQ ID NO:2. Protein fragments may be "free-standing," or comprised within a larger polypeptide of which the fragment forms a part or region, most preferably as a single continuous region. Antibodies of the present invention may bind polypeptide fragments, including, for example, fragments that comprise or alternatively, consist of from about amino acid residues: 1 to 26, 27 to 54, 55 to 79, 80 to 103, 104 to 128, 129 to 152, 153-176, 177-200, 201-224, 225-248, 249-273, 274-305, 306-335, 336-365, 366-395, 396-434, 435-447, and/or 448-473 of SEQ ID NO:2. In this context "about" includes the particularly recited value, larger or smaller by several (5, 4, 3, 2, or 1) amino acids, at either extreme or at both extremes. Moreover, polypeptide fragments bound by the antibodies of the invention can be at least about 10, 20, 30, 40, 50, 60, 70, 80, 90, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, or 470 amino acids in length. In this context "about" includes the particularly recited value, larger or smaller by several (5, 4, 3, 2, or 1) amino acids, at either extreme or at both extremes.

Preferably, antibodies of the present invention bind polypeptide fragments selected from the group: a polypeptide comprising or alternatively, consisting of, the full length NogoR polypeptide (amino acid residues 1 to 473 in SEQ ID NO:2); a polypeptide comprising or alternatively, consisting of, the secreted form of NogoR (amino acid residues 27 to 473 in SEQ ID NO:2); a polypeptide comprising or alternatively, consisting of, fragment of the secreted NogoR polypeptide; and a polypeptide comprising, or alternatively, consisting of, one, two, three, four or more, epitope bearing portions of the NogoR protein. In additional embodiments, the polypeptide fragments of the invention comprise, or alternatively, consist of, any combination of or all of the above members.

Antibodies of the invention may also bind fragments comprising, or alternatively, consisting of, structural or functional attributes of NogoR. Such fragments include amino acid residues that comprise alpha-helix and alpha-helix forming regions ("alpha-regions"), beta-sheet and beta-sheet-forming regions ("beta-regions"), turn and turn-forming regions ("turn-regions"), coil and coil-forming regions ("coil-regions"), hydrophilic regions, hydrophobic regions, alpha amphipathic regions, beta amphipathic regions, surface forming regions, and high antigenic index regions (i.e., containing four or more contiguous amino acids having an antigenic index of greater than or equal to 1.5, as identified using the default parameters of the Jameson-Wolf program) of complete (i.e., full-length) NogoR. Certain preferred regions are those set out in Table 2 and include, but are not limited to, regions of the aforementioned types identified by analysis of the amino acid sequence depicted in SEQ ID NO:2, such preferred regions include; Garnier-Robson predicted alpha-regions, beta-regions, turn-regions, and coil-regions; Chou-Fasman predicted alpha-regions, beta-regions, and turn-regions; Kyte-Doolittle predicted hydrophilic regions; Eisenberg alpha and beta amphipathic regions; Emini surface-forming regions; and Jameson-Wolf high antigenic index regions, as predicted using the default parameters of these computer programs.

The data representing the structural or functional attributes of NogoR set forth in Table 2, as described above, was generated using the various modules and algorithms of the DNA*STAR set on default parameters. Column I represents the results of a Garnier-Robson analysis of alpha helical regions; Column II represents the results of a Chou-Fasman analysis of alpha helical regions; Column III represents the results of a Garnier Robson analysis of beta sheet regions; Column IV represents the results of a Chou-Fasman analysis of beta sheet regions; Column V represents the results of a Garnier Robson analysis of turn regions; Column VI represents the results of a Chou-Fasman analysis of turn regions; Column VII represents the results of a Garnier Robson analysis of coil regions; Column VIII represents a Kyte-Doolittle hydrophilicity plot; Column; Column IX represents the results of an Eisenberg analysis of alpha amphipathic regions; Column X represents the results of an Eisenberg analysis of beta amphipathic regions; Column XI represents the results of a Karplus-Schultz analysis of flexible regions; Column XII represents the Jameson-Wolf antigenic index score; and Column XIII represents the Emini surface probability plot.

In a preferred embodiment, the data presented in columns VIII, XII, and XIII of Table 2 can be used to determine regions of NogoR which exhibit a high degree of potential for antigenicity. Regions of high antigenicity are determined from the data presented in columns VIII, XII, and/or XIII by choosing values which represent regions of the polypeptide which are likely to be exposed on the surface of the polypeptide in an environment in which antigen recognition may occur in the process of initiation of an immune response.

The above-mentioned preferred regions set out in Table 2 include, but are not limited to, regions of the aforementioned types identified by analysis of the amino acid sequence set out in SEQ ID NO:2. As set out in Table 2, such preferred regions include Garnier-Robson alpha-regions, beta-regions, turn-regions, and coil-regions, Chou-Fasman alpha-regions, beta-regions, and turn-regions, Kyte-Doolittle hydrophilic regions, Eisenberg alpha- and beta-amphipathic regions, Karplus-Schulz flexible regions, Jameson-Wolf regions of high antigenic index and Emini surface-forming regions. Among preferred polypeptide fragments bound by one or more antibodies of the invention are those that comprise regions of NogoR that combine several structural features, such as several (e.g., 1, 2, 3, or 4) of the same or different region features set out above and in Table 2.

TABLE 2

| Res | Position | I | II | III | IV | V | VI | VII | VIII | IX | X | XI | XII | XIII |
|---|---|---|---|---|---|---|---|---|---|---|---|---|---|---|
| Met | 1 | A | A | . | . | . | . | . | 0.61 | . | . | . | 0.75 | 1.47 |
| Lys | 2 | A | A | . | . | . | . | . | 0.41 | . | . | . | 0.96 | 1.54 |
| Arg | 3 | . | A | B | . | . | . | . | 0.46 | * | . | . | 1.17 | 1.22 |
| Ala | 4 | A | A | . | . | . | . | . | 0.50 | * | . | . | 1.38 | 1.22 |
| Ser | 5 | A | . | . | . | . | T | . | 0.59 | * | . | F | 1.99 | 0.60 |
| Ala | 6 | . | . | . | . | . | T | C | 1.30 | * | . | F | 2.10 | 0.41 |
| Gly | 7 | . | . | . | . | . | T | C | 0.44 | * | . | F | 1.89 | 0.80 |
| Gly | 8 | . | . | . | . | . | T | C | −0.48 | * | * | F | 1.68 | 0.49 |
| Ser | 9 | . | A | . | . | . | . | C | −0.48 | . | . | F | 0.47 | 0.40 |
| Arg | 10 | . | A | B | . | . | . | . | −0.47 | * | . | F | 0.06 | 0.41 |
| Leu | 11 | . | A | B | . | . | . | . | −0.73 | * | . | . | −0.60 | 0.43 |
| Leu | 12 | . | A | B | . | . | . | . | −1.20 | * | . | . | −0.60 | 0.24 |
| Ala | 13 | . | A | B | . | . | . | . | −1.14 | * | . | . | −0.60 | 0.10 |
| Trp | 14 | . | A | B | . | . | . | . | −1.66 | . | * | . | −0.60 | 0.13 |
| Val | 15 | . | A | B | . | . | . | . | −1.77 | . | * | . | −0.60 | 0.13 |
| Leu | 16 | A | A | . | . | . | . | . | −1.54 | . | . | . | −0.60 | 0.22 |
| Trp | 17 | A | A | . | . | . | . | . | −1.02 | . | . | . | −0.60 | 0.21 |
| Leu | 18 | A | A | . | . | . | . | . | −0.43 | . | . | . | −0.60 | 0.30 |
| Gln | 19 | A | A | . | . | . | . | . | −1.00 | . | . | . | −0.60 | 0.63 |
| Ala | 20 | . | A | . | . | T | . | . | −0.73 | . | . | . | −0.20 | 0.45 |
| Trp | 21 | . | A | . | . | T | . | . | −0.51 | . | . | . | −0.20 | 0.55 |
| Gln | 22 | . | A | B | . | . | . | . | −0.43 | . | . | . | −0.60 | 0.32 |
| Val | 23 | . | A | B | . | . | . | . | −0.29 | . | . | . | −0.60 | 0.49 |
| Ala | 24 | . | A | B | . | . | . | . | −0.50 | . | . | . | −0.60 | 0.25 |
| Ala | 25 | . | A | B | . | . | . | . | −0.26 | . | . | . | −0.60 | 0.22 |
| Pro | 26 | . | A | . | . | T | . | . | −0.56 | . | * | . | −0.20 | 0.30 |
| Cys | 27 | . | . | . | . | T | T | . | −1.22 | . | . | . | 0.50 | 0.30 |
| Pro | 28 | . | . | . | . | T | T | . | −1.22 | . | . | . | 0.20 | 0.16 |
| Gly | 29 | . | . | . | . | T | T | . | −1.30 | . | . | . | 0.20 | 0.08 |
| Ala | 30 | . | . | B | . | . | T | . | −0.96 | . | . | . | −0.20 | 0.08 |
| Cys | 31 | . | . | B | . | . | . | . | −0.74 | . | . | . | −0.40 | 0.08 |
| Val | 32 | . | . | B | . | . | . | . | −0.08 | . | . | . | −0.40 | 0.12 |
| Cys | 33 | . | . | B | . | . | T | . | −0.08 | . | . | . | −0.20 | 0.21 |
| Tyr | 34 | . | . | B | . | . | T | . | 0.31 | . | . | . | 0.36 | 0.62 |
| Asn | 35 | . | . | B | . | . | T | . | 0.04 | . | . | F | 1.52 | 1.66 |
| Glu | 36 | . | . | B | . | . | T | . | 0.40 | . | . | F | 1.78 | 2.30 |

TABLE 2-continued

| Res | Position | I | II | III | IV | V | VI | VII | VIII | IX | X | XI | XII | XIII |
|---|---|---|---|---|---|---|---|---|---|---|---|---|---|---|
| Pro | 37 | . | . | . | B | T | . | . | 0.94 | . | . | F | 2.04 | 2.11 |
| Lys | 38 | . | . | . | B | T | . | . | 1.31 | . | * | F | 2.60 | 1.90 |
| Val | 39 | . | . | . | B | T | . | . | 0.89 | . | * | F | 2.34 | 1.47 |
| Thr | 40 | . | . | B | B | . | . | . | 0.68 | . | * | F | 1.23 | 0.51 |
| Thr | 41 | . | . | B | B | . | . | . | 0.68 | . | * | F | 0.97 | 0.39 |
| Ser | 42 | . | . | B | B | . | . | . | 0.89 | * | * | F | 0.11 | 0.92 |
| Cys | 43 | . | . | B | . | . | . | T | 0.50 | * | * | F | 0.40 | 1.10 |
| Pro | 44 | . | . | . | . | T | T | . | 0.54 | . | . | F | 0.65 | 0.76 |
| Gln | 45 | . | . | . | . | T | T | . | 0.86 | . | . | F | 0.65 | 0.47 |
| Gln | 46 | . | . | B | . | . | T | . | 0.58 | * | . | F | 0.40 | 1.50 |
| Gly | 47 | . | A | B | . | . | . | . | 0.02 | * | . | F | −0.15 | 0.98 |
| Leu | 48 | . | A | B | B | . | . | . | 0.48 | . | . | . | −0.60 | 0.42 |
| Gln | 49 | . | A | B | B | . | . | . | −0.17 | . | . | . | −0.60 | 0.38 |
| Ala | 50 | . | A | B | B | . | . | . | −0.51 | * | . | . | −0.60 | 0.28 |
| Val | 51 | . | A | B | B | . | . | . | −1.40 | * | . | . | −0.60 | 0.34 |
| Pro | 52 | . | . | B | B | . | . | . | −1.27 | . | . | . | −0.60 | 0.14 |
| Val | 53 | . | . | B | B | . | . | . | −1.04 | . | . | . | −0.60 | 0.21 |
| Gly | 54 | . | . | B | . | . | . | . | −1.63 | . | . | . | −0.40 | 0.29 |
| Ile | 55 | . | . | B | . | . | . | . | −1.34 | . | . | . | −0.40 | 0.19 |
| Pro | 56 | . | . | B | . | . | . | . | −0.49 | . | * | . | −0.40 | 0.34 |
| Ala | 57 | A | . | . | . | . | . | . | −0.17 | . | * | . | −0.10 | 0.59 |
| Ala | 58 | A | . | . | . | . | . | . | −0.20 | * | . | . | 0.65 | 1.64 |
| Ser | 59 | A | . | . | B | . | . | . | −0.56 | * | * | F | 0.45 | 0.75 |
| Gln | 60 | . | . | B | B | . | . | . | −0.48 | * | * | F | −0.15 | 0.64 |
| Arg | 61 | . | . | B | B | . | . | . | −0.30 | . | * | F | −0.45 | 0.52 |
| Ile | 62 | . | . | B | B | . | . | . | −0.06 | . | * | . | −0.60 | 0.53 |
| Phe | 63 | . | . | B | B | . | . | . | 0.53 | * | * | . | −0.60 | 0.30 |
| Leu | 64 | . | . | B | B | . | . | . | 0.94 | * | * | . | −0.60 | 0.25 |
| His | 65 | . | . | . | . | T | T | . | 0.06 | * | * | . | 0.26 | 0.69 |
| Gly | 66 | . | . | . | . | T | T | . | −0.36 | * | * | F | 0.47 | 0.56 |
| Asn | 67 | . | . | . | . | T | T | . | 0.50 | * | . | F | 0.83 | 0.91 |
| Arg | 68 | . | . | . | . | T | T | . | 0.34 | . | . | F | 1.49 | 0.91 |
| Ile | 69 | . | . | . | . | T | . | . | 0.94 | . | . | . | 0.60 | 0.69 |
| Ser | 70 | . | . | B | . | . | . | . | 0.39 | * | . | . | 0.14 | 0.66 |
| His | 71 | . | . | B | . | . | . | . | 0.14 | * | . | . | 0.08 | 0.34 |
| Val | 72 | . | . | B | . | . | . | . | −0.16 | * | . | . | −0.28 | 0.49 |
| Pro | 73 | . | . | B | . | . | . | . | −0.97 | * | * | . | −0.04 | 0.49 |
| Ala | 74 | . | . | . | . | T | . | . | 0.03 | * | * | . | 0.00 | 0.31 |
| Ala | 75 | A | . | . | . | . | . | . | −0.26 | . | * | . | −0.10 | 0.82 |
| Ser | 76 | A | . | . | . | . | . | . | −0.89 | * | . | . | −0.10 | 0.54 |
| Phe | 77 | A | . | . | . | . | . | . | 0.08 | * | * | . | −0.10 | 0.29 |
| Arg | 78 | A | . | . | . | . | . | . | 0.29 | * | * | . | 0.60 | 0.55 |
| Ala | 79 | A | . | . | . | . | . | . | 0.07 | * | * | . | 0.70 | 0.66 |
| Cys | 80 | A | . | . | . | . | . | . | 0.34 | * | * | . | 1.00 | 0.63 |
| Arg | 81 | . | . | . | . | T | T | . | −0.24 | * | * | . | 1.50 | 0.47 |
| Asn | 82 | . | . | . | . | T | T | . | −0.36 | * | * | . | 1.00 | 0.32 |
| Leu | 83 | . | . | B | . | . | T | . | −0.76 | . | . | . | 0.20 | 0.50 |
| Thr | 84 | . | . | B | B | . | . | . | −0.98 | * | . | . | −0.30 | 0.27 |
| Ile | 85 | . | . | B | B | . | . | . | −0.34 | . | . | . | −0.40 | 0.14 |
| Leu | 86 | . | . | B | B | . | . | . | −0.76 | . | . | . | −0.50 | 0.23 |
| Trp | 87 | . | . | B | B | . | . | . | −0.76 | . | * | . | −0.60 | 0.21 |
| Leu | 88 | . | . | B | B | . | . | . | −0.80 | . | . | . | −0.60 | 0.48 |
| His | 89 | . | . | B | . | . | T | . | −1.30 | . | . | . | −0.20 | 0.43 |
| Ser | 90 | . | . | . | . | . | T | C | −1.00 | * | * | . | 0.00 | 0.34 |
| Asn | 91 | . | . | . | . | . | T | C | −0.08 | * | * | . | 0.00 | 0.42 |
| Val | 92 | A | . | . | . | . | T | . | −0.68 | * | * | . | 0.10 | 0.60 |
| Leu | 93 | A | A | . | . | . | . | . | 0.13 | . | * | . | −0.30 | 0.31 |
| Ala | 94 | A | A | . | . | . | . | . | −0.42 | . | * | . | 0.30 | 0.33 |
| Arg | 95 | A | A | . | . | . | . | . | −0.71 | * | * | . | −0.30 | 0.44 |
| Ile | 96 | A | A | . | . | . | . | . | −1.30 | * | * | . | 0.30 | 0.54 |
| Asp | 97 | A | A | . | . | . | . | . | −1.14 | . | * | . | 0.30 | 0.54 |
| Ala | 98 | A | A | . | . | . | . | . | −0.64 | * | * | . | 0.30 | 0.24 |
| Ala | 99 | A | A | . | . | . | . | . | −0.40 | * | * | . | −0.60 | 0.49 |
| Ala | 100 | A | A | . | . | . | . | . | −1.32 | . | * | . | −0.30 | 0.29 |
| Phe | 101 | A | A | . | . | . | . | . | −1.02 | . | . | . | −0.60 | 0.24 |
| Thr | 102 | A | A | . | . | . | . | . | −1.83 | . | . | . | −0.60 | 0.24 |
| Gly | 103 | A | A | . | . | . | . | . | −2.06 | . | . | . | −0.60 | 0.19 |
| Leu | 104 | A | A | . | . | . | . | . | −1.47 | . | . | . | −0.60 | 0.19 |
| Ala | 105 | A | A | . | . | . | . | . | −0.88 | . | . | . | −0.60 | 0.22 |
| Leu | 106 | A | A | . | . | . | . | . | −0.99 | . | . | . | −0.30 | 0.39 |
| Leu | 107 | A | A | . | . | . | . | . | −0.68 | . | * | . | −0.60 | 0.39 |
| Glu | 108 | A | A | . | . | . | . | . | −1.14 | . | * | . | 0.30 | 0.64 |
| Gln | 109 | A | A | . | . | . | . | . | −0.63 | . | * | . | −0.30 | 0.64 |
| Leu | 110 | A | A | . | . | . | . | . | −0.04 | . | * | . | 0.45 | 1.05 |
| Asp | 111 | A | A | . | . | . | . | . | 0.77 | . | * | . | 0.75 | 1.01 |
| Leu | 112 | A | A | . | . | . | . | . | 0.99 | . | * | . | 0.30 | 0.94 |
| Ser | 113 | A | . | . | . | . | T | . | 0.99 | . | * | F | 1.00 | 1.15 |
| Asp | 114 | A | . | . | . | . | T | . | 0.18 | . | * | F | 1.30 | 1.19 |

TABLE 2-continued

| Res | Position | I | II | III | IV | V | VI | VII | VIII | IX | X | XI | XII | XIII |
|---|---|---|---|---|---|---|---|---|---|---|---|---|---|---|
| Asn | 115 | A | . | . | . | . | . | T | . | 1.10 | . | * | F | 0.40 | 1.19 |
| Ala | 116 | A | . | . | . | . | . | T | . | 0.80 | . | * | . | 1.15 | 1.74 |
| Gln | 117 | . | A | B | . | . | . | . | . | 0.76 | . | * | . | 0.75 | 1.40 |
| Leu | 118 | . | A | B | . | . | . | . | . | 1.06 | . | * | . | −0.30 | 0.64 |
| Arg | 119 | . | A | B | . | . | . | . | . | 0.84 | * | * | F | 0.60 | 1.07 |
| Ser | 120 | . | A | B | . | . | . | . | . | 0.26 | * | * | F | 0.53 | 0.95 |
| Val | 121 | . | . | B | . | . | . | . | . | 0.53 | . | * | F | 0.96 | 1.17 |
| Asp | 122 | . | . | B | . | . | . | T | . | −0.17 | . | * | F | 1.39 | 0.86 |
| Pro | 123 | . | . | B | . | . | . | T | . | 0.61 | * | * | F | 0.57 | 0.55 |
| Ala | 124 | . | . | B | . | . | . | T | . | 0.16 | * | . | F | 0.80 | 1.02 |
| Thr | 125 | . | . | B | . | . | . | T | . | −0.36 | . | . | . | 0.42 | 0.60 |
| Phe | 126 | . | . | B | . | . | . | . | . | 0.16 | . | * | . | −0.16 | 0.32 |
| His | 127 | A | . | . | . | . | . | . | . | 0.27 | * | * | . | −0.24 | 0.31 |
| Gly | 128 | . | . | . | . | . | . | . | C | −0.33 | * | * | . | 0.18 | 0.43 |
| Leu | 129 | . | A | . | . | . | . | . | C | 0.22 | * | * | . | −0.40 | 0.41 |
| Gly | 130 | . | A | . | . | . | . | . | C | 0.22 | * | * | . | −0.10 | 0.41 |
| Arg | 131 | A | A | . | . | . | . | . | . | 0.11 | * | * | . | −0.30 | 0.59 |
| Leu | 132 | A | A | . | . | . | . | . | . | 0.11 | . | * | . | −0.60 | 0.59 |
| His | 133 | . | A | B | . | . | . | . | . | −0.36 | * | * | . | −0.30 | 0.82 |
| Thr | 134 | . | A | B | . | . | . | . | . | 0.46 | * | . | . | −0.60 | 0.34 |
| Leu | 135 | . | A | B | . | . | . | . | . | 0.91 | * | * | . | −0.38 | 0.70 |
| His | 136 | . | A | B | . | . | . | . | . | 0.13 | * | . | . | 0.89 | 1.00 |
| Leu | 137 | . | A | B | . | . | . | . | . | 0.60 | . | . | . | 0.96 | 0.37 |
| Asp | 138 | . | . | . | . | T | . | T | . | −0.18 | * | . | . | 1.98 | 0.45 |
| Arg | 139 | . | . | . | . | T | . | T | . | 0.13 | . | . | . | 2.20 | 0.27 |
| Cys | 140 | . | . | . | . | T | . | T | . | 0.94 | * | . | . | 1.98 | 0.57 |
| Gly | 141 | . | . | B | . | . | . | T | . | 0.17 | * | . | . | 1.66 | 0.59 |
| Leu | 142 | . | A | B | . | . | . | . | . | 0.63 | * | . | . | 0.74 | 0.25 |
| Gln | 143 | . | A | B | . | . | . | . | . | 0.42 | * | . | . | −0.08 | 0.46 |
| Glu | 144 | . | A | B | . | . | . | . | . | −0.03 | * | * | F | −0.15 | 0.72 |
| Leu | 145 | . | A | B | . | . | . | . | . | −0.18 | * | * | F | −0.15 | 0.86 |
| Gly | 146 | . | . | . | . | . | . | T | C | −0.53 | * | * | F | 0.45 | 0.41 |
| Pro | 147 | . | . | . | . | . | T | T | . | 0.39 | * | * | F | 0.35 | 0.20 |
| Gly | 148 | . | . | . | . | . | . | T | C | 0.04 | * | . | F | 0.15 | 0.49 |
| Leu | 149 | . | . | B | . | . | . | T | . | −0.77 | * | * | . | 0.10 | 0.49 |
| Phe | 150 | . | . | B | . | . | . | . | . | −0.54 | * | * | . | −0.60 | 0.26 |
| Arg | 151 | . | A | B | . | . | . | . | . | −0.79 | * | * | . | −0.60 | 0.26 |
| Gly | 152 | . | A | B | . | . | . | . | . | −1.39 | * | * | . | −0.60 | 0.32 |
| Leu | 153 | A | A | . | . | . | . | . | . | −1.04 | * | * | . | −0.60 | 0.31 |
| Ala | 154 | A | A | . | . | . | . | . | . | −0.48 | * | * | . | −0.30 | 0.27 |
| Ala | 155 | A | A | . | . | . | . | . | . | −0.59 | * | * | . | −0.60 | 0.43 |
| Leu | 156 | A | A | . | . | . | . | . | . | −0.94 | . | * | . | −0.60 | 0.43 |
| Gln | 157 | . | A | B | . | . | . | . | . | −1.41 | . | . | . | −0.60 | 0.67 |
| Tyr | 158 | . | A | B | . | . | . | . | . | −0.60 | . | . | . | −0.60 | 0.55 |
| Leu | 159 | . | A | B | . | . | . | . | . | −0.01 | . | . | . | −0.45 | 1.15 |
| Tyr | 160 | . | A | B | . | . | . | . | . | 0.58 | . | . | . | −0.45 | 1.11 |
| Leu | 161 | . | . | B | . | . | . | T | . | 0.80 | . | . | . | −0.05 | 1.14 |
| Gln | 162 | . | . | B | . | . | . | T | . | −0.01 | . | . | . | −0.05 | 1.39 |
| Asp | 163 | . | . | B | . | . | . | T | . | 0.23 | . | . | . | −0.20 | 0.73 |
| Asn | 164 | . | . | B | . | . | . | T | . | 0.46 | * | . | . | 0.25 | 1.54 |
| Ala | 165 | . | A | B | . | . | . | . | . | −0.11 | * | . | . | 0.30 | 0.90 |
| Leu | 166 | . | A | B | . | . | . | . | . | 0.49 | * | . | . | −0.30 | 0.44 |
| Gln | 167 | . | A | B | . | . | . | . | . | 0.49 | * | . | . | −0.32 | 0.43 |
| Ala | 168 | . | A | B | . | . | . | . | . | 0.49 | * | . | . | 0.26 | 0.70 |
| Leu | 169 | . | . | B | . | . | . | T | . | 0.18 | * | . | . | 1.69 | 1.43 |
| Pro | 170 | . | . | B | . | . | . | . | . | 0.07 | * | * | F | 2.42 | 1.19 |
| Asp | 171 | . | . | . | . | T | . | T | . | 0.99 | * | * | F | 2.80 | 1.02 |
| Asp | 172 | . | . | B | . | . | . | T | . | 0.99 | * | . | F | 2.42 | 2.42 |
| Thr | 173 | . | . | B | . | . | . | . | . | 0.77 | * | . | F | 1.94 | 2.61 |
| Phe | 174 | . | . | B | . | . | . | . | . | 1.23 | * | . | F | 1.87 | 1.29 |
| Arg | 175 | . | . | B | . | . | . | . | . | 1.44 | * | * | F | 1.65 | 0.76 |
| Asp | 176 | A | . | . | . | . | . | . | . | 0.63 | * | * | F | 1.28 | 0.85 |
| Leu | 177 | . | . | . | . | . | T | . | . | 0.32 | * | * | F | 1.89 | 0.81 |
| Gly | 178 | . | . | . | . | . | T | . | . | 0.60 | * | * | F | 2.10 | 0.60 |
| Asn | 179 | . | . | . | . | . | . | . | C | 0.49 | * | * | . | 0.94 | 0.60 |
| Leu | 180 | A | . | . | B | . | . | . | . | −0.32 | * | . | . | 0.03 | 0.49 |
| Thr | 181 | . | . | B | B | . | . | . | . | −1.13 | * | . | . | −0.18 | 0.43 |
| His | 182 | . | . | B | B | . | . | . | . | −0.36 | * | . | . | −0.39 | 0.22 |
| Leu | 183 | . | . | B | B | . | . | . | . | −0.36 | . | * | . | −0.60 | 0.36 |
| Phe | 184 | . | . | B | B | . | . | . | . | −0.36 | * | . | . | −0.60 | 0.25 |
| Leu | 185 | . | . | B | B | . | . | . | . | 0.57 | * | . | . | −0.60 | 0.29 |
| His | 186 | . | . | B | . | . | . | T | . | −0.01 | * | . | . | −0.20 | 0.69 |
| Gly | 187 | . | . | . | . | T | . | T | . | −0.28 | * | . | F | 0.35 | 0.56 |
| Asn | 188 | . | . | . | . | . | T | T | . | 0.23 | * | . | F | 0.65 | 0.91 |
| Arg | 189 | . | . | . | . | . | T | T | . | 0.08 | . | . | F | 1.25 | 0.90 |
| Ile | 190 | . | . | . | . | . | . | . | C | 0.68 | . | . | F | 0.85 | 0.67 |
| Ser | 191 | . | . | . | . | . | . | . | C | 0.71 | * | . | F | 0.85 | 0.65 |
| Ser | 192 | . | . | B | . | . | . | . | . | 1.17 | * | * | F | 0.65 | 0.57 |

TABLE 2-continued

| Res | Position | I | II | III | IV | V | VI | VII | VIII | IX | X | XI | XII | XIII |
|---|---|---|---|---|---|---|---|---|---|---|---|---|---|---|
| Val | 193 | . | . | B | . | . | . | . | 0.58 | * | . | F | 0.80 | 1.60 |
| Pro | 194 | . | A | B | . | . | . | . | −0.23 | * | . | F | 0.90 | 1.21 |
| Glu | 195 | . | A | B | . | . | . | . | 0.77 | * | . | F | 0.45 | 0.78 |
| Arg | 196 | A | A | . | . | . | . | . | 0.72 | * | . | F | 0.90 | 2.06 |
| Ala | 197 | A | A | . | . | . | . | . | 0.21 | * | . | . | 0.75 | 1.32 |
| Phe | 198 | A | A | . | . | . | . | . | 1.03 | * | . | . | 0.60 | 0.63 |
| Arg | 199 | A | A | . | . | . | . | . | 0.94 | * | . | . | 0.30 | 0.44 |
| Gly | 200 | A | A | . | . | . | . | . | 0.13 | * | * | . | −0.30 | 0.58 |
| Leu | 201 | A | A | . | . | . | . | . | 0.02 | * | . | . | −0.60 | 0.55 |
| His | 202 | . | A | . | . | . | . | C | 0.72 | * | * | . | 0.50 | 0.47 |
| Ser | 203 | . | A | . | . | . | . | C | 0.61 | * | * | . | 0.50 | 0.93 |
| Leu | 204 | A | A | . | . | . | . | . | −0.31 | * | . | . | 0.30 | 0.93 |
| Asp | 205 | A | A | . | . | . | . | . | −0.78 | * | . | . | 0.30 | 0.56 |
| Arg | 206 | A | A | . | B | . | . | . | 0.00 | * | . | . | −0.30 | 0.35 |
| Leu | 207 | A | A | . | B | . | . | . | 0.03 | * | . | . | −0.30 | 0.57 |
| Leu | 208 | A | A | . | B | . | . | . | 0.33 | * | . | . | 0.30 | 0.59 |
| Leu | 209 | A | A | . | B | . | . | . | 1.26 | * | . | . | −0.30 | 0.49 |
| His | 210 | A | . | . | . | . | T | . | 0.40 | * | . | . | 0.25 | 1.16 |
| Gln | 211 | A | . | . | . | . | T | . | −0.30 | * | * | F | 0.40 | 1.04 |
| Asn | 212 | A | . | . | . | . | T | . | 0.48 | * | . | F | 0.40 | 1.28 |
| Arg | 213 | A | . | . | . | . | T | . | 0.43 | . | . | . | 0.85 | 1.28 |
| Val | 214 | A | A | . | . | . | . | . | 1.21 | . | . | . | −0.30 | 0.55 |
| Ala | 215 | . | A | B | . | . | . | . | 1.03 | . | . | . | −0.30 | 0.46 |
| His | 216 | . | A | B | . | . | . | . | 1.00 | . | * | . | −0.30 | 0.37 |
| Val | 217 | . | A | B | . | . | . | . | 0.41 | * | . | . | −0.60 | 0.67 |
| His | 218 | . | A | B | . | . | . | . | −0.40 | * | . | . | −0.60 | 0.67 |
| Pro | 219 | . | A | B | . | . | . | . | 0.57 | * | . | . | −0.60 | 0.43 |
| His | 220 | A | . | . | . | . | . | . | 1.16 | * | . | . | 0.05 | 1.12 |
| Ala | 221 | A | . | . | . | . | . | . | 0.38 | * | . | . | 0.65 | 1.38 |
| Phe | 222 | A | . | . | . | . | . | . | 0.89 | * | * | . | 0.50 | 0.74 |
| Arg | 223 | A | . | . | . | . | . | . | 1.03 | * | * | . | 0.50 | 0.54 |
| Asp | 224 | A | . | . | . | . | . | . | 0.43 | * | * | F | 1.10 | 1.04 |
| Leu | 225 | A | . | . | . | . | . | . | −0.13 | * | * | F | 0.65 | 0.99 |
| Gly | 226 | A | . | . | . | . | . | . | 0.14 | * | * | F | 0.95 | 0.50 |
| Arg | 227 | A | . | . | B | . | . | . | 0.03 | * | * | . | 0.30 | 0.43 |
| Leu | 228 | . | . | B | B | . | . | . | −0.32 | * | . | . | −0.60 | 0.43 |
| Met | 229 | . | . | B | B | . | . | . | −1.13 | * | . | . | −0.60 | 0.68 |
| Thr | 230 | . | . | B | B | . | . | . | −1.02 | . | . | . | −0.60 | 0.29 |
| Leu | 231 | . | . | B | B | . | . | . | −1.27 | . | * | . | −0.60 | 0.30 |
| Tyr | 232 | . | . | B | B | . | . | . | −1.38 | . | . | . | −0.60 | 0.31 |
| Leu | 233 | . | . | B | B | . | . | . | −0.57 | . | . | . | −0.60 | 0.34 |
| Phe | 234 | A | . | . | . | . | T | . | −0.78 | . | . | . | −0.20 | 0.67 |
| Ala | 235 | A | . | . | . | . | T | . | −0.77 | . | . | . | −0.20 | 0.35 |
| Asn | 236 | A | . | . | . | . | T | . | −0.54 | * | . | . | −0.20 | 0.57 |
| Asn | 237 | . | . | . | . | . | T | C | −1.11 | . | . | . | 0.00 | 0.67 |
| Leu | 238 | . | A | . | . | . | . | C | −0.51 | . | . | . | −0.40 | 0.55 |
| Ser | 239 | . | A | . | . | . | . | C | −0.12 | * | . | . | −0.40 | 0.52 |
| Ala | 240 | . | A | . | . | . | . | C | 0.47 | * | . | . | −0.40 | 0.47 |
| Leu | 241 | . | A | . | . | . | . | C | −0.12 | * | . | . | −0.10 | 0.99 |
| Pro | 242 | A | A | . | . | . | . | . | −0.93 | . | . | F | 0.45 | 0.75 |
| Thr | 243 | A | A | . | . | . | . | . | −0.71 | . | . | F | −0.15 | 0.61 |
| Glu | 244 | A | A | . | . | . | . | . | −0.62 | . | . | F | −0.15 | 0.75 |
| Ala | 245 | A | A | . | . | . | . | . | −0.84 | * | * | . | −0.30 | 0.75 |
| Leu | 246 | A | A | . | . | . | . | . | 0.08 | * | * | . | −0.30 | 0.43 |
| Ala | 247 | A | A | . | . | . | . | . | −0.30 | * | * | . | 0.30 | 0.48 |
| Pro | 248 | A | A | . | . | . | . | . | −0.80 | * | * | . | −0.30 | 0.48 |
| Leu | 249 | A | A | . | . | . | . | . | −0.80 | * | * | . | −0.60 | 0.48 |
| Arg | 250 | A | A | . | . | . | . | . | −0.46 | * | * | . | −0.30 | 0.83 |
| Ala | 251 | A | A | . | . | . | . | . | −0.46 | * | * | . | −0.60 | 0.84 |
| Leu | 252 | A | A | . | . | . | . | . | 0.24 | * | * | . | −0.60 | 0.84 |
| Gln | 253 | . | A | B | . | . | . | . | −0.36 | * | * | . | −0.30 | 0.84 |
| Tyr | 254 | . | A | B | . | . | . | . | 0.46 | . | * | . | −0.60 | 0.68 |
| Leu | 255 | . | A | B | . | . | . | . | 0.34 | * | * | . | −0.17 | 1.33 |
| Arg | 256 | . | A | B | . | . | . | . | 0.93 | * | * | . | 1.01 | 1.28 |
| Leu | 257 | . | A | . | . | . | T | . | 1.53 | * | * | . | 1.69 | 1.32 |
| Asn | 258 | . | . | . | . | T | T | . | 1.24 | * | * | F | 2.52 | 2.47 |
| Asp | 259 | . | . | . | . | T | T | . | 0.63 | . | * | F | 2.80 | 1.33 |
| Asn | 260 | . | . | . | . | . | T | C | 0.78 | . | * | F | 1.42 | 1.19 |
| Pro | 261 | . | . | . | . | T | T | . | 0.67 | . | * | F | 1.49 | 0.40 |
| Trp | 262 | . | . | . | . | T | T | . | 0.81 | . | * | . | 1.46 | 0.40 |
| Val | 263 | . | . | B | . | . | . | . | 0.92 | . | * | . | 0.19 | 0.13 |
| Cys | 264 | . | . | B | . | . | T | . | 0.33 | . | * | . | 0.72 | 0.17 |
| Asp | 265 | . | . | B | . | . | T | . | 0.44 | . | * | . | 1.03 | 0.16 |
| Cys | 266 | . | . | B | . | . | T | . | 0.44 | . | * | . | 2.24 | 0.43 |
| Arg | 267 | . | . | . | . | T | T | . | −0.08 | . | * | . | 3.10 | 1.23 |
| Ala | 268 | . | . | . | . | T | . | . | 0.49 | . | * | . | 2.44 | 0.61 |
| Arg | 269 | . | . | . | . | T | . | C | 0.57 | . | * | . | 1.38 | 1.19 |
| Pro | 270 | . | . | . | . | T | . | C | 0.28 | . | * | . | 0.92 | 0.61 |

TABLE 2-continued

| Res | Position | I | II | III | IV | V | VI | VII | VIII | IX | X | XI | XII | XIII |
|---|---|---|---|---|---|---|---|---|---|---|---|---|---|---|
| Leu | 271 | A | . | . | . | . | T | . | 0.13 | . | * | . | 0.11 | 0.64 |
| Trp | 272 | A | . | . | . | . | T | . | 0.02 | * | * | . | −0.20 | 0.27 |
| Ala | 273 | A | A | . | . | . | . | . | 0.66 | * | . | . | −0.60 | 0.30 |
| Trp | 274 | A | A | . | . | . | . | . | −0.16 | * | * | . | −0.60 | 0.73 |
| Leu | 275 | A | A | . | . | . | . | . | 0.17 | * | * | . | −0.60 | 0.60 |
| Gln | 276 | . | A | B | . | . | . | . | 0.63 | * | * | . | −0.15 | 1.17 |
| Lys | 277 | . | A | B | . | . | . | . | 0.62 | . | * | F | 0.34 | 1.10 |
| Phe | 278 | . | A | . | . | T | . | . | 0.91 | . | * | F | 1.68 | 1.79 |
| Arg | 279 | . | A | . | . | T | . | . | 0.90 | * | * | F | 2.32 | 1.38 |
| Gly | 280 | . | . | . | . | T | T | . | 1.71 | * | * | F | 2.91 | 0.93 |
| Ser | 281 | . | . | . | . | T | T | . | 0.86 | * | * | F | 3.40 | 1.85 |
| Ser | 282 | . | . | . | . | T | T | C | 0.60 | . | * | F | 2.71 | 0.70 |
| Ser | 283 | . | . | . | . | T | T | . | 0.63 | . | * | F | 2.42 | 1.10 |
| Glu | 284 | . | . | . | . | T | . | . | 0.22 | . | * | F | 1.73 | 0.44 |
| Val | 285 | . | . | B | . | . | T | . | −0.24 | . | . | F | 1.19 | 0.44 |
| Pro | 286 | . | . | . | . | T | T | . | −0.16 | . | . | . | 0.50 | 0.27 |
| Cys | 287 | . | . | . | . | T | T | . | 0.14 | . | * | . | 0.50 | 0.24 |
| Ser | 288 | . | . | B | . | . | T | . | 0.56 | * | * | . | −0.20 | 0.56 |
| Leu | 289 | . | . | B | . | . | . | . | −0.26 | * | * | F | 0.65 | 0.71 |
| Pro | 290 | . | . | B | . | . | . | . | 0.01 | . | * | F | 0.20 | 1.10 |
| Gln | 291 | . | A | B | . | . | . | . | −0.12 | * | * | F | −0.15 | 0.83 |
| Arg | 292 | . | A | B | . | . | . | . | 0.66 | * | * | F | −0.15 | 0.99 |
| Leu | 293 | . | A | B | . | . | . | . | 0.96 | * | * | F | 0.90 | 1.26 |
| Ala | 294 | . | A | B | . | . | . | . | 0.96 | * | * | F | 0.90 | 1.21 |
| Gly | 295 | A | . | . | . | . | T | . | 1.21 | * | * | F | 1.15 | 0.51 |
| Arg | 296 | A | . | . | . | . | T | . | 1.32 | * | * | F | 1.30 | 1.24 |
| Asp | 297 | A | . | . | . | . | T | . | 0.40 | * | * | F | 1.30 | 2.40 |
| Leu | 298 | A | . | . | . | . | T | . | 0.62 | * | * | F | 1.30 | 2.00 |
| Lys | 299 | A | A | . | . | . | . | . | 0.62 | * | * | F | 0.90 | 1.03 |
| Arg | 300 | A | A | . | . | . | . | . | 0.97 | * | . | . | 0.60 | 0.62 |
| Leu | 301 | A | A | . | . | . | . | . | 0.86 | * | . | . | 0.45 | 1.22 |
| Ala | 302 | A | A | . | . | . | . | . | 0.04 | * | . | . | 0.75 | 1.01 |
| Ala | 303 | A | A | . | . | . | . | . | 0.86 | * | . | . | 0.30 | 0.43 |
| Asn | 304 | A | A | . | . | . | . | . | 0.47 | * | . | . | −0.30 | 0.90 |
| Asp | 305 | A | A | . | . | . | . | . | −0.31 | * | * | F | 0.45 | 0.88 |
| Leu | 306 | A | . | . | . | . | T | . | −0.09 | . | . | F | 0.85 | 0.47 |
| Gln | 307 | . | . | B | . | . | T | . | −0.36 | . | . | . | 0.70 | 0.29 |
| Gly | 308 | . | . | B | . | . | T | . | −0.36 | . | . | . | 0.10 | 0.13 |
| Cys | 309 | . | . | B | . | . | T | . | −0.67 | . | . | . | −0.20 | 0.16 |
| Ala | 310 | . | . | B | B | . | . | . | −1.01 | . | * | . | −0.60 | 0.13 |
| Val | 311 | . | . | B | B | . | . | . | −0.41 | . | . | . | −0.60 | 0.13 |
| Ala | 312 | . | . | B | B | . | . | . | −0.66 | . | . | . | −0.60 | 0.38 |
| Thr | 313 | . | . | B | B | . | . | . | −0.34 | . | . | F | −0.45 | 0.59 |
| Gly | 314 | . | . | B | . | . | T | . | 0.11 | . | . | F | 0.10 | 1.09 |
| Pro | 315 | . | . | . | . | T | T | . | −0.19 | . | . | F | 0.50 | 1.67 |
| Tyr | 316 | . | . | . | . | . | T | C | 0.38 | . | . | . | 0.00 | 0.81 |
| His | 317 | . | . | B | . | . | T | . | 0.66 | . | . | . | −0.20 | 0.86 |
| Pro | 318 | . | . | B | . | . | . | . | 0.62 | . | * | . | −0.40 | 0.80 |
| Ile | 319 | . | . | B | . | . | . | . | 1.08 | . | * | . | −0.40 | 0.51 |
| Trp | 320 | . | . | B | . | . | T | . | 0.70 | . | . | . | −0.20 | 0.73 |
| Thr | 321 | . | . | B | . | . | T | . | 0.63 | . | * | F | −0.05 | 0.48 |
| Gly | 322 | . | . | . | . | . | T | C | 0.67 | . | * | F | 0.15 | 0.98 |
| Arg | 323 | . | . | . | . | . | T | C | 0.88 | . | * | F | 1.20 | 1.56 |
| Ala | 324 | . | A | . | . | . | . | C | 1.77 | . | . | F | 1.10 | 1.87 |
| Thr | 325 | . | A | . | . | . | . | C | 1.84 | . | * | F | 1.41 | 3.28 |
| Asp | 326 | . | A | . | . | . | . | C | 1.34 | . | * | F | 1.72 | 2.59 |
| Glu | 327 | . | A | B | . | . | . | . | 1.34 | . | * | F | 1.83 | 2.11 |
| Glu | 328 | A | . | . | . | . | T | . | 0.42 | . | * | F | 2.54 | 1.45 |
| Pro | 329 | . | . | . | . | T | T | . | 0.80 | . | . | F | 3.10 | 0.72 |
| Leu | 330 | . | . | . | . | T | T | . | 1.16 | . | . | F | 2.49 | 0.64 |
| Gly | 331 | . | . | . | . | T | T | . | 0.49 | . | . | F | 2.18 | 0.74 |
| Leu | 332 | . | . | . | . | . | . | C | −0.18 | . | . | . | 0.72 | 0.26 |
| Pro | 333 | . | . | . | . | T | T | . | −0.18 | . | . | . | 0.81 | 0.17 |
| Lys | 334 | . | . | . | . | T | T | . | −0.18 | . | . | . | 0.50 | 0.29 |
| Cys | 335 | . | . | B | . | . | T | . | 0.63 | . | . | . | 0.10 | 0.55 |
| Cys | 336 | . | . | B | . | . | T | . | 0.39 | . | . | . | 1.00 | 0.59 |
| Gln | 337 | . | . | B | . | . | T | . | 0.61 | . | . | . | 1.00 | 0.30 |
| Pro | 338 | . | . | B | . | . | T | . | 0.82 | . | . | F | 0.85 | 0.56 |
| Asp | 339 | A | . | . | . | . | T | . | 0.82 | . | . | F | 1.30 | 1.75 |
| Ala | 340 | A | . | . | . | . | T | . | 0.90 | . | * | F | 1.30 | 2.02 |
| Ala | 341 | A | A | . | . | . | . | . | 1.27 | . | * | F | 0.90 | 1.32 |
| Asp | 342 | A | A | . | . | . | . | . | 0.41 | . | * | F | 0.90 | 1.06 |
| Lys | 343 | A | A | . | . | . | . | . | −0.19 | . | * | F | 0.45 | 0.78 |
| Ala | 344 | A | A | . | . | . | . | . | −0.19 | . | . | F | 0.45 | 0.63 |
| Ser | 345 | . | A | B | . | . | . | . | 0.19 | . | . | . | 0.60 | 0.66 |
| Val | 346 | . | A | B | . | . | . | . | 0.43 | . | * | . | 0.64 | 0.51 |
| Leu | 347 | . | A | B | . | . | . | . | 0.54 | . | * | . | 0.38 | 0.50 |
| Glu | 348 | . | . | B | . | . | T | . | 0.29 | * | * | F | 1.87 | 0.73 |

TABLE 2-continued

| Res | Position | I | II | III | IV | V | VI | VII | VIII | IX | X | XI | XII | XIII |
|---|---|---|---|---|---|---|---|---|---|---|---|---|---|---|
| Pro | 349 | . | . | . | . | T | T | . | 0.29 | * | . | F | 2.76 | 1.52 |
| Gly | 350 | . | . | . | . | T | T | . | 0.29 | * | . | F | 3.40 | 1.86 |
| Arg | 351 | . | . | . | . | . | T | C | 0.56 | * | . | F | 2.86 | 1.44 |
| Pro | 352 | . | . | . | . | . | . | C | 1.02 | . | . | F | 1.87 | 0.94 |
| Ala | 353 | A | . | . | . | . | . | . | 1.02 | . | . | F | 1.33 | 0.94 |
| Ser | 354 | A | . | . | . | . | T | . | 0.64 | . | . | F | 1.19 | 0.77 |
| Ala | 355 | A | . | . | . | . | T | . | 0.18 | . | * | F | 0.25 | 0.50 |
| Gly | 356 | A | . | . | . | . | T | . | 0.11 | . | * | F | 0.25 | 0.41 |
| Asn | 357 | . | . | B | . | . | T | . | −0.02 | . | * | . | 0.70 | 0.61 |
| Ala | 358 | . | . | B | . | . | . | . | 0.68 | . | * | F | 0.65 | 0.60 |
| Leu | 359 | . | . | B | . | . | . | . | 0.12 | . | * | F | 1.10 | 1.19 |
| Lys | 360 | . | . | B | . | . | . | . | 0.50 | . | * | F | 0.65 | 0.55 |
| Gly | 361 | . | . | B | . | . | . | . | 0.63 | . | * | F | 0.96 | 0.84 |
| Arg | 362 | . | . | B | . | . | . | . | 0.29 | . | * | F | 1.42 | 1.58 |
| Val | 363 | . | . | B | . | . | . | . | 0.88 | . | * | F | 1.88 | 0.78 |
| Pro | 364 | . | . | B | . | . | T | . | 1.39 | . | * | F | 2.54 | 1.32 |
| Pro | 365 | . | . | . | . | T | T | . | 1.13 | . | * | F | 3.10 | 0.90 |
| Gly | 366 | . | . | . | . | T | T | . | 1.27 | . | * | F | 2.64 | 1.88 |
| Asp | 367 | . | . | . | . | T | T | . | 0.81 | . | . | F | 2.33 | 1.88 |
| Ser | 368 | . | . | . | . | . | . | C | 1.67 | . | . | F | 1.62 | 1.20 |
| Pro | 369 | . | . | . | . | . | T | C | 1.53 | . | . | F | 1.81 | 1.95 |
| Pro | 370 | . | . | . | . | T | T | . | 1.44 | . | . | F | 2.00 | 1.16 |
| Gly | 371 | . | . | . | . | T | T | . | 1.44 | . | . | F | 2.00 | 1.16 |
| Asn | 372 | . | . | . | . | T | T | . | 1.23 | . | . | F | 2.15 | 0.74 |
| Gly | 373 | . | . | . | . | T | T | . | 1.64 | . | . | F | 2.45 | 0.74 |
| Ser | 374 | . | . | . | . | . | T | C | 1.82 | * | . | F | 3.00 | 1.47 |
| Gly | 375 | . | . | . | . | . | T | C | 1.14 | * | . | F | 2.40 | 1.24 |
| Pro | 376 | . | . | B | . | . | T | . | 1.49 | * | . | F | 1.75 | 0.88 |
| Arg | 377 | . | . | B | . | . | . | . | 1.49 | * | . | F | 1.40 | 1.05 |
| His | 378 | . | . | B | . | . | . | . | 1.53 | * | . | . | 1.25 | 1.78 |
| Ile | 379 | . | . | B | . | . | . | . | 1.62 | * | . | . | 1.20 | 1.54 |
| Asn | 380 | . | . | B | . | . | . | . | 1.27 | * | . | F | 1.60 | 1.22 |
| Asp | 381 | . | . | . | . | T | . | . | 1.13 | * | . | F | 1.20 | 0.77 |
| Ser | 382 | . | . | . | . | . | T | C | 0.71 | * | . | F | 1.60 | 1.09 |
| Pro | 383 | . | . | . | . | T | T | . | −0.07 | . | . | F | 2.50 | 0.98 |
| Phe | 384 | . | . | . | . | T | T | . | 0.61 | . | . | F | 1.65 | 0.48 |
| Gly | 385 | . | . | . | . | T | T | . | 0.27 | . | . | F | 1.10 | 0.56 |
| Thr | 386 | . | . | B | . | . | . | . | −0.03 | . | . | F | 0.49 | 0.36 |
| Leu | 387 | . | . | . | . | . | T | C | −0.32 | . | . | F | 0.88 | 0.55 |
| Pro | 388 | . | . | . | . | . | T | C | −0.11 | . | * | F | 1.17 | 0.57 |
| Gly | 389 | . | . | . | . | T | T | . | 0.38 | . | . | F | 2.21 | 0.68 |
| Ser | 390 | . | . | . | . | . | T | C | 0.51 | . | * | F | 2.40 | 1.27 |
| Ala | 391 | . | . | . | . | . | . | C | 0.23 | . | * | F | 1.96 | 1.27 |
| Glu | 392 | . | . | . | . | . | . | C | 1.01 | . | * | F | 1.72 | 1.30 |
| Pro | 393 | . | . | B | . | . | . | . | 0.56 | . | * | F | 1.28 | 1.32 |
| Pro | 394 | A | . | . | . | . | T | . | 0.60 | . | * | F | 1.09 | 0.70 |
| Ala | 395 | A | . | . | . | . | T | . | 0.31 | . | * | . | 0.70 | 0.54 |
| His | 396 | A | . | . | . | . | T | . | 0.31 | . | * | . | 0.10 | 0.35 |
| Cys | 397 | A | . | . | . | . | T | . | 0.42 | . | * | . | 0.10 | 0.23 |
| Ser | 398 | A | . | . | . | . | . | . | 0.29 | * | . | . | 0.50 | 0.45 |
| Ala | 399 | A | . | . | . | . | . | . | −0.31 | * | . | . | 0.50 | 0.33 |
| Ala | 400 | A | . | . | . | . | . | . | 0.39 | * | . | . | −0.10 | 0.50 |
| Arg | 401 | A | . | . | . | . | . | . | −0.17 | * | . | . | 0.80 | 0.73 |
| Gly | 402 | A | . | . | . | . | . | . | 0.19 | * | . | . | 0.50 | 0.73 |
| Leu | 403 | . | . | B | B | . | . | . | 0.60 | * | . | . | 0.45 | 1.05 |
| Arg | 404 | . | . | B | B | . | . | . | 0.49 | * | . | . | 0.75 | 1.05 |
| Ala | 405 | . | . | B | B | . | . | . | 0.87 | * | . | . | 0.30 | 0.92 |
| Thr | 406 | . | . | B | B | . | . | . | 0.44 | * | . | F | 0.60 | 1.72 |
| Arg | 407 | . | . | B | B | . | . | . | 0.49 | * | . | F | 0.60 | 1.26 |
| Phe | 408 | . | . | B | . | . | T | . | 0.96 | * | * | F | 0.40 | 1.68 |
| Pro | 409 | . | . | . | . | T | T | . | 0.63 | * | . | F | 1.74 | 1.15 |
| Thr | 410 | . | . | . | . | T | T | . | 1.33 | * | * | F | 1.93 | 0.91 |
| Ser | 411 | . | . | . | . | T | T | C | 1.76 | * | * | F | 2.22 | 2.05 |
| Gly | 412 | . | . | . | . | . | T | C | 1.76 | * | * | F | 2.86 | 2.60 |
| Pro | 413 | . | . | . | . | T | T | . | 2.24 | . | . | F | 3.40 | 3.53 |
| Arg | 414 | . | . | . | . | T | T | . | 2.11 | . | . | F | 3.06 | 4.08 |
| Arg | 415 | . | . | . | . | T | T | . | 1.76 | . | . | F | 2.72 | 4.08 |
| Arg | 416 | . | . | B | . | . | T | . | 1.76 | . | . | F | 1.98 | 1.41 |
| Pro | 417 | . | . | . | . | T | T | . | 2.21 | . | . | F | 2.23 | 0.97 |
| Gly | 418 | . | . | . | . | T | T | . | 2.47 | . | . | F | 2.23 | 0.97 |
| Cys | 419 | . | . | . | . | T | T | . | 2.36 | . | . | F | 2.57 | 0.99 |
| Ser | 420 | . | . | . | . | T | . | . | 2.36 | . | . | F | 2.86 | 1.03 |
| Arg | 421 | . | . | . | . | T | T | . | 1.93 | . | * | F | 3.40 | 2.03 |
| Lys | 422 | . | . | . | . | T | T | . | 2.26 | . | * | F | 3.06 | 5.47 |
| Asn | 423 | . | . | . | . | T | T | . | 2.30 | . | * | F | 2.98 | 7.99 |
| Arg | 424 | . | . | . | . | T | T | . | 2.93 | . | * | F | 2.90 | 5.47 |
| Thr | 425 | . | . | . | . | T | . | . | 2.57 | . | * | F | 2.62 | 3.72 |
| Arg | 426 | . | . | . | . | T | T | . | 2.57 | . | * | F | 2.74 | 1.24 |

TABLE 2-continued

| Res | Position | I | II | III | IV | V | VI | VII | VIII | IX | X | XI | XII | XIII |
|---|---|---|---|---|---|---|---|---|---|---|---|---|---|---|
| Ser | 427 | . | . | B | . | . | T | . | 1.71 | * | * | F | 2.60 | 1.24 |
| His | 428 | . | . | B | . | . | T | . | 1.37 | * | * | . | 1.74 | 0.71 |
| Cys | 429 | . | . | B | . | . | T | . | 1.26 | * | * | . | 1.48 | 0.36 |
| Arg | 430 | . | . | B | . | . | . | . | 0.98 | * | * | . | 1.02 | 0.46 |
| Leu | 431 | . | . | B | . | . | . | . | 0.52 | * | * | . | 0.16 | 0.34 |
| Gly | 432 | . | . | B | . | . | . | . | 0.52 | . | * | . | -0.10 | 0.63 |
| Gln | 433 | . | . | B | . | . | . | . | 0.21 | * | * | F | 0.65 | 0.43 |
| Ala | 434 | . | . | B | . | . | . | . | 0.53 | * | . | F | 0.05 | 0.52 |
| Gly | 435 | . | . | . | . | . | T | C | 0.08 | * | . | F | 1.05 | 0.52 |
| Ser | 436 | . | . | . | . | . | T | C | 0.54 | . | . | F | 1.05 | 0.30 |
| Gly | 437 | . | . | . | . | . | T | C | 0.58 | . | . | F | 0.45 | 0.29 |
| Gly | 438 | . | . | . | . | . | T | C | 0.23 | . | . | F | 0.71 | 0.43 |
| Gly | 439 | . | . | . | . | . | T | C | 0.82 | . | . | F | 0.97 | 0.31 |
| Gly | 440 | . | . | . | . | . | T | C | 0.87 | . | . | F | 1.83 | 0.53 |
| Thr | 441 | . | . | . | . | . | T | C | 1.17 | . | . | F | 2.09 | 0.72 |
| Gly | 442 | . | . | B | . | . | T | . | 1.17 | . | . | F | 2.60 | 1.26 |
| Asp | 443 | . | . | B | . | . | T | . | 1.21 | . | * | F | 2.34 | 1.26 |
| Ser | 444 | . | . | B | . | . | T | . | 1.21 | . | . | F | 2.29 | 1.17 |
| Glu | 445 | . | . | B | . | . | T | . | 0.97 | . | * | F | 2.24 | 1.17 |
| Gly | 446 | . | . | . | . | T | T | . | 0.47 | . | * | F | 2.44 | 0.71 |
| Ser | 447 | . | . | . | . | T | . | . | 0.60 | . | * | F | 1.89 | 0.43 |
| Gly | 448 | . | . | . | . | T | . | . | 0.30 | . | . | F | 2.10 | 0.39 |
| Ala | 449 | . | . | . | . | . | . | C | -0.21 | . | . | F | 1.09 | 0.52 |
| Leu | 450 | . | . | B | . | . | T | . | -0.52 | . | . | F | 0.58 | 0.32 |
| Pro | 451 | . | . | B | . | . | T | . | -0.84 | . | . | F | 0.37 | 0.47 |
| Ser | 452 | . | . | B | . | . | T | . | -0.84 | . | . | F | 0.16 | 0.25 |
| Leu | 453 | . | . | B | . | . | T | . | -1.31 | . | . | . | -0.20 | 0.41 |
| Thr | 454 | . | . | B | . | . | . | . | -1.03 | . | . | . | -0.40 | 0.22 |
| Cys | 455 | . | . | B | . | . | . | . | -0.43 | * | . | . | -0.40 | 0.23 |
| Ser | 456 | . | . | B | . | . | . | . | -1.03 | . | . | . | -0.40 | 0.44 |
| Leu | 457 | . | . | B | . | . | . | . | -1.08 | . | . | . | -0.40 | 0.25 |
| Thr | 458 | . | . | B | . | . | T | . | -1.08 | . | . | F | -0.05 | 0.46 |
| Pro | 459 | . | . | B | . | . | T | . | -1.36 | . | . | F | -0.05 | 0.28 |
| Leu | 460 | . | . | B | . | . | T | . | -1.50 | . | . | . | -0.20 | 0.35 |
| Gly | 461 | . | . | B | . | . | T | . | -2.06 | . | . | . | -0.20 | 0.20 |
| Leu | 462 | . | . | B | B | . | . | . | -2.06 | . | . | . | -0.60 | 0.10 |
| Ala | 463 | . | . | B | B | . | . | . | -2.03 | . | . | . | -0.60 | 0.10 |
| Leu | 464 | . | . | B | B | . | . | . | -2.13 | . | . | . | -0.60 | 0.10 |
| Val | 465 | . | . | B | B | . | . | . | -2.18 | . | . | . | -0.60 | 0.18 |
| Leu | 466 | . | . | B | B | . | . | . | -2.64 | . | . | . | -0.60 | 0.13 |
| Trp | 467 | . | . | B | B | . | . | . | -2.18 | . | . | . | -0.60 | 0.13 |
| Thr | 468 | . | . | B | B | . | . | . | -1.80 | . | . | . | -0.60 | 0.17 |
| Val | 469 | . | . | B | B | . | . | . | -1.66 | . | . | . | -0.60 | 0.33 |
| Leu | 470 | . | . | B | B | . | . | . | -1.19 | . | . | . | -0.60 | 0.17 |
| Gly | 471 | . | . | . | B | . | . | C | -0.77 | . | . | . | -0.40 | 0.15 |
| Pro | 472 | . | . | . | . | T | . | . | -0.87 | . | . | . | 0.00 | 0.25 |
| Cys | 473 | . | . | . | . | T | . | . | -0.94 | . | . | . | 0.30 | 0.39 |

In another aspect, the invention provides an antibody that binds a peptide or polypeptide comprising an epitope-bearing portion of a polypeptide described herein.

As to the selection of peptides or polypeptides bearing an antigenic epitope (i.e., that contain a region of a protein molecule to which an antibody can bind), it is well known in that art that relatively short synthetic peptides that mimic part of a protein sequence are routinely capable of eliciting an antiserum that reacts with the partially mimicked protein. See, for instance, Sutcliffe et al., *Science* 219:660-666 (1983). Peptides capable of eliciting protein-reactive sera are frequently represented in the primary sequence of a protein, can be characterized by a set of simple chemical rules, and are confined neither to immunodominant regions of intact proteins (i.e., immunogenic epitopes) nor to the amino or carboxyl terminals.

Antigenic epitope-bearing peptides and polypeptides are therefore useful to raise antibodies, including monoclonal antibodies, that bind to a NogoR polypeptide of the invention. See, for instance, Wilson et al., *Cell* 37:767-778 (1984) at 777. Antigenic epitope-bearing peptides and polypeptides preferably contain a sequence of at least seven, more preferably at least nine and most preferably between at least about 15 to about 30 amino acids contained within the amino acid sequence of SEQ ID NO:2.

Antibodies of the invention may bind one or more antigenic NogoR polypeptides or peptides including, but not limited to: a polypeptide comprising amino acid residues from about 5 to about 8 of SEQ ID NO:2; a polypeptide comprising amino acid residues from about 35 to about 39 of SEQ ID NO:2; a polypeptide comprising amino acid residues from about 138 to about 141 of SEQ ID NO:2; a polypeptide comprising amino acid residues from about 169 to about 175 of SEQ ID NO:2; a polypeptide comprising amino acid residues from about 278 to about 284 of SEQ ID NO:2; a polypeptide comprising amino acid residues from about 326 to about 331 of SEQ ID NO:2; a polypeptide comprising amino acid residues from about 348 to about 352 of SEQ ID NO:2; a polypeptide comprising amino acid residues from about 363 to about 376 of SEQ ID NO:2; a polypeptide comprising amino acid residues from about 389 to about 392 of SEQ ID NO:2; a polypeptide comprising amino acid residues from about 409 to about 428 of SEQ ID NO:2; and/or a polypeptide comprising amino acid residues from about 440 to about 448 of SEQ ID NO:2. In this context "about"

includes the particularly recited range, larger or smaller by several (5, 4, 3, 2, or 1) amino acids, at either terminus or at both termini. As indicated above, the inventors have determined that the above polypeptide fragments are antigenic regions of the NogoR protein. Epitope-bearing NogoR peptides and polypeptides may be produced by any conventional means (Houghten, *Proc Natl Acad Sci USA* 82:5131-5135 (1985)). This "Simultaneous Multiple Peptide Synthesis (SMPS)" process is further described in U.S. Pat. No. 4,631, 211 to Houghten et al. (1986).

As one of skill in the art will appreciate, NogoR polypeptides and the epitope-bearing fragments thereof described herein can be combined with parts of the constant domain of immunoglobulins (IgG), resulting in chimeric polypeptides. These fusion proteins facilitate purification and show an increased half-life in vivo. This has been shown, e.g., for chimeric proteins consisting of the first two domains of the human CD4-polypeptide and various domains of the constant regions of the heavy or light chains of mammalian immunoglobulins (EPA 394,827; Traunecker et al. *Nature* 331:84-86 (1988)). Fusion proteins that have a disulfide-linked dimeric structure due to the IgG part can also be more efficient in binding and neutralizing other molecules than the monomeric NogoR protein or protein fragment alone (Fountoulakis et al., *J Biochem* 270:3958-3964 (1995)). Thus, antibodies of the invention may bind the NogoR moiety of fusion proteins that comprise all or a portion of a NogoR polypeptide.

Recombinant DNA technology known to those skilled in the art can be used to create novel mutant proteins or "muteins" including single or multiple amino acid substitutions, deletions, additions or fusion proteins. Such modified polypeptides can show, e.g., enhanced activity or increased stability. In addition, they may be purified in higher yields and show better solubility than the corresponding natural polypeptide, at least under certain purification and storage conditions. Antibodies of the present invention may also bind such modified NogoR polypeptides or NogoR polypeptide fragments or variants.

For instance, for many proteins, it is known in the art that one or more amino acids may be deleted from the N-terminus or C-terminus without substantial loss of biological function, or loss of the ability to be bound by a specific antibody. For instance, Ron et al. *J Biol Chem,* 268:2984-2988 (1993) reported modified KGF proteins that had heparin binding activity even if 3, 8, or 27 amino-terminal amino acid residues were missing.

However, even if deletion of one or more amino acids from the N-terminus of a protein results in modification or loss of one or more biological functions of the protein, other functional activities (e.g., biological activities, ability to multimerize) may still be retained. For example, the ability of shortened NogoR polypeptides to induce and/or bind to antibodies which recognize the complete or mature forms of the NogoR polypeptides generally will be retained when less than the majority of the residues of the complete or mature polypeptide are removed from the N-terminus. Whether a particular polypeptide lacking N-terminal residues of a complete polypeptide retains such immunologic activities can readily be determined by routine methods described herein and otherwise known in the art. It is not unlikely that a NogoR polypeptide with a large number of deleted N-terminal amino acid residues may retain some biological or immunogenic activities. In fact, peptides composed of as few as six NogoR amino acid residues may often evoke an immune response.

Accordingly, the present invention further provides antibodies that bind polypeptides having one or more residues deleted from the amino terminus of the NogoR amino acid sequence of SEQ ID NO:2 up to the threonine residue at position number 468. In particular, the present invention provides antibodies that bind polypeptides comprising the amino acid sequence of residues $n^1$-473 of SEQ ID NO:2, where $n^1$ is an integer from 27 to 468 corresponding to the position of the amino acid residue in SEQ ID NO:2.

More in particular, the invention provides antibodies that bind polypeptides comprising, or alternatively consisting of, the amino acid sequence of residues of C-27 to C-473; P-28 to C-473; G-29 to C-473; A-30 to C-473; C-31 to C-473; V-32 to C-473; C-33 to C-473; Y-34 to C-473; N-35 to C-473; E-36 to C-473; P-37 to C-473; K-38 to C-473; V-39 to C-473; T-40 to C-473; T-41 to C-473; S-42 to C-473; C-43 to C-473; P-44 to C-473; Q-45 to C-473; Q-46 to C-473; G-47 to C-473; L-48 to C-473; Q-49 to C-473; A-50 to C-473; V-51 to C-473; P-52 to C-473; V-53 to C-473; G-54 to C-473; I-55 to C-473; P-56 to C-473; A-57 to C-473; A-58 to C-473; S-59 to C-473; Q-60 to C-473; R-61 to C-473; I-62 to C-473; F-63 to C-473; L-64 to C-473; H-65 to C-473; G-66 to C-473; N-67 to C-473; R-68 to C-473; I-69 to C-473; S-70 to C-473; H-71 to C-473; V-72 to C-473; P-73 to C-473; A-74 to C-473; A-75 to C-473; S-76 to C-473; F-77 to C-473; R-78 to C-473; A-79 to C-473; C-80 to C-473; R-81 to C-473; N-82 to C-473; L-83 to C-473; T-84 to C-473; I-85 to C-473; L-86 to C-473; W-87 to C-473; L-88 to C-473; H-89 to C-473; S-90 to C-473; N-91 to C-473; V-92 to C-473; L-93 to C-473; A-94 to C-473; R-95 to C-473; I-96 to C-473; D-97 to C-473; A-98 to C-473; A-99 to C-473; A-100 to C-473; F-101 to C-473; T-102 to C-473; G-103 to C-473; L-104 to C-473; A-105 to C-473; L-106 to C-473; L-107 to C-473; E-108 to C-473; Q-109 to C-473; L-110 to C-473; D-111 to C-473; L-112 to C-473; S-113 to C-473; D-114 to C-473; N-115 to C-473; A-116 to C-473; Q-117 to C-473; L-118 to C-473; R-119 to C-473; S-120 to C-473; V-121 to C-473; D-122 to C-473; P-123 to C-473; A-124 to C-473; T-125 to C-473; F-126 to C-473; H-127 to C-473; G-128 to C-473; L-129 to C-473; G-130 to C-473; R-131 to C-473; L-132 to C-473; H-133 to C-473; T-134 to C-473; L-135 to C-473; H-136 to C-473; L-137 to C-473; D-138 to C-473; R-139 to C-473; C-140 to C-473; G-141 to C-473; L-142 to C-473; Q-143 to C-473; E-144 to C-473; L-145 to C-473; G-146 to C-473; P-147 to C-473; G-148 to C-473; L-149 to C-473; F-150 to C-473; R-151 to C-473; G-152 to C-473; L-153 to C-473; A-154 to C-473; A-155 to C-473; L-156 to C-473; Q-157 to C-473; Y-158 to C-473; L-159 to C-473; Y-160 to C-473; L-161 to C-473; Q-162 to C-473; D-163 to C-473; N-164 to C-473; A-165 to C-473; L-166 to C-473; Q-167 to C-473; A-168 to C-473; L-169 to C-473; P-170 to C-473; D-171 to C-473; D-172 to C-473; T-173 to C-473; F-174 to C-473; R-175 to C-473; D-176 to C-473; L-177 to C-473; G-178 to C-473; N-179 to C-473; L-180 to C-473; T-181 to C-473; H-182 to C-473; L-183 to C-473; F-184 to C-473; L-185 to C-473; H-186 to C-473; G-187 to C-473; N-188 to C-473; R-189 to C-473; I-190 to C-473; S-191 to C-473; S-192 to C-473; V-193 to C-473; P-194 to C-473; E-195 to C-473; R-196 to C-473; A-197 to C-473; F-198 to C-473; R-199 to C-473; G-200 to C-473; L-201 to C-473; H-202 to C-473; S-203 to C-473; L-204 to C-473; D-205 to C-473; R-206 to C-473; L-207 to C-473; L-208 to C-473; L-209 to C-473; H-210 to C-473; Q-211 to C-473; N-212 to C-473; R-213 to C-473; V-214 to C-473; A-215 to C-473; H-216 to C-473; V-217 to C-473; H-218 to C-473; P-219 to C-473; H-220 to C-473; A-221 to C-473; F-222 to C-473; R-223 to C-473; D-224 to C-473; L-225 to C-473; G-226 to C-473; R-227 to C-473; L-228 to C-473; M-229 to C-473; T-230 to C-473; L-231 to C-473; Y-232 to C-473; L-233 to C-473; F-234 to C-473; A-235 to C-473; N-236 to C-473; N-237 to C-473; L-238 to C-473; S-239 to C-473;

A-240 to C-473; L-241 to C-473; P-242 to C-473; T-243 to C-473; E-244 to C-473; A-245 to C-473; L-246 to C-473; A-247 to C-473; P-248 to C-473; L-249 to C-473; R-250 to C-473; A-251 to C-473; L-252 to C-473; Q-253 to C-473; Y-254 to C-473; L-255 to C-473; R-256 to C-473; L-257 to C-473; N-258 to C-473; D-259 to C-473; N-260 to C-473; P-261 to C-473; W-262 to C-473; V-263 to C-473; C-264 to C-473; D-265 to C-473; C-266 to C-473; R-267 to C-473; A-268 to C-473; R-269 to C-473; P-270 to C-473; L-271 to C-473; W-272 to C-473; A-273 to C-473; W-274 to C-473; L-275 to C-473; Q-276 to C-473; K-277 to C-473; F-278 to C-473; R-279 to C-473; G-280 to C-473; S-281 to C-473; S-282 to C-473; S-283 to C-473; E-284 to C-473; V-285 to C-473; P-286 to C-473; C-287 to C-473; S-288 to C-473; L-289 to C-473; P-290 to C-473; Q-291 to C-473; R-292 to C-473; L-293 to C-473; A-294 to C-473; G-295 to C-473; R-296 to C-473; D-297 to C-473; L-298 to C-473; K-299 to C-473; R-300 to C-473; L-301 to C-473; A-302 to C-473; A-303 to C-473; N-304 to C-473; D-305 to C-473; L-306 to C-473; Q-307 to C-473; G-308 to C-473; C-309 to C-473; A-310 to C-473; V-311 to C-473; A-312 to C-473; T-313 to C-473; G-314 to C-473; P-315 to C-473; Y-316 to C-473; H-317 to C-473; P-318 to C-473; I-319 to C-473; W-320 to C-473; T-321 to C-473; G-322 to C-473; R-323 to C-473; A-324 to C-473; T-325 to C-473; D-326 to C-473; E-327 to C-473; E-328 to C-473; P-329 to C-473; L-330 to C-473; G-331 to C-473; L-332 to C-473; P-333 to C-473; K-334 to C-473; C-335 to C-473; C-336 to C-473; Q-337 to C-473; P-338 to C-473; D-339 to C-473; A-340 to C-473; A-341 to C-473; D-342 to C-473; K-343 to C-473; A-344 to C-473; S-345 to C-473; V-346 to C-473; L-347 to C-473; E-348 to C-473; P-349 to C-473; G-350 to C-473; R-351 to C-473; P-352 to C-473; A-353 to C-473; S-354 to C-473; A-355 to C-473; G-356 to C-473; N-357 to C-473; A-358 to C-473; L-359 to C-473; K-360 to C-473; G-361 to C-473; R-362 to C-473; V-363 to C-473; P-364 to C-473; P-365 to C-473; G-366 to C-473; D-367 to C-473; S-368 to C-473; P-369 to C-473; P-370 to C-473; G-371 to C-473; N-372 to C-473; G-373 to C-473; S-374 to C-473; G-375 to C-473; P-376 to C-473; R-377 to C-473; H-378 to C-473; I-379 to C-473; N-380 to C-473; D-381 to C-473; S-382 to C-473; P-383 to C-473; F-384 to C-473; G-385 to C-473; T-386 to C-473; L-387 to C-473; P-388 to C-473; G-389 to C-473; S-390 to C-473; A-391 to C-473; E-392 to C-473; P-393 to C-473; P-394 to C-473; A-395 to C-473; H-396 to C-473; C-397 to C-473; S-398 to C-473; A-399 to C-473; A-400 to C-473; R-401 to C-473; G-402 to C-473; L-403 to C-473; R-404 to C-473; A-405 to C-473; T-406 to C-473; R-407 to C-473; F-408 to C-473; P-409 to C-473; T-410 to C-473; S-411 to C-473; G-412 to C-473; P-413 to C-473; R-414 to C-473; R-415 to C-473; R-416 to C-473; P-417 to C-473; G-418 to C-473; C-419 to C-473; S-420 to C-473; R-421 to C-473; K-422 to C-473; N-423 to C-473; R-424 to C-473; T-425 to C-473; R-426 to C-473; S-427 to C-473; H-428 to C-473; C-429 to C-473; R-430 to C-473; L-431 to C-473; G-432 to C-473; Q-433 to C-473; A-434 to C-473; G-435 to C-473; S-436 to C-473; G-437 to C-473; G-438 to C-473; G-439 to C-473; G-440 to C-473; T-441 to C-473; G-442 to C-473; D-443 to C-473; S-444 to C-473; E-445 to C-473; G-446 to C-473; S-447 to C-473; G-448 to C-473; A-449 to C-473; L-450 to C-473; P-451 to C-473; S-452 to C-473; L-453 to C-473; T-454 to C-473; C-455 to C-473; S-456 to C-473; L-457 to C-473; T-458 to C-473; P-459 to C-473; L-460 to C-473; G-461 to C-473; L-462 to C-473; A-463 to C-473; L-464 to C-473; V-465 to C-473; L-466 to C-473; W-467 to C-473; and/or T-468 to C-473 of the amino acid sequence of SEQ ID NO:2.

As mentioned above, even if deletion of one or more amino acids from the C-terminus of a protein results in modification of loss of one or more biological functions of the protein, other functional activities (e.g., biological activities, ability to multimerize) may still be retained. For example, the ability of the shortened NogoR polypeptide to induce and/or bind to antibodies which recognize the complete or mature forms of the NogoR polypeptide generally will be retained when less than the majority of the residues of the complete or mature polypeptide are removed from the C-terminus. Whether a particular polypeptide lacking C-terminal residues of a complete polypeptide retains such immunologic activities can readily be determined by routine methods described herein and otherwise known in the art. It is not unlikely that a NogoR polypeptide with a large number of deleted C-terminal amino acid residues may retain some biological or immunogenic activities. In fact, peptides composed of as few as six NogoR amino acid residues may often evoke an immune response.

Accordingly, the present invention further provides antibodies that bind polypeptides having one or more residues deleted from the carboxy terminus of the amino acid sequence of the NogoR polypeptide sequence of SEQ ID NO:2 up to the cysteine residue at position number 33. In particular, the present invention provides antibodies that bind polypeptides comprising the amino acid sequence of residues 27-$m^1$ of SEQ ID NO:2, where $m^1$ is an integer from 33 to 473 corresponding to the position of the amino acid residue in SEQ ID NO:2.

More in particular, the invention provides antibodies that bind polypeptides comprising, or alternatively consisting of, the amino acid sequence of residues C-27 to P-472; C-27 to G-471; C-27 to L-470; C-27 to V-469; C-27 to T-468; C-27 to W-467; C-27 to L-466; C-27 to V-465; C-27 to L-464; C-27 to A463; C-27 to L-462; C-27 to G-461; C-27 to L-460; C-27 to P-459; C-27 to T-458; C-27 to L-457; C-27 to S-456; C-27 to C-455; C-27 to T-454; C-27 to L-453; C-27 to S-452; C-27 to P-451; C-27 to L-450; C-27 to A449; C-27 to G-448; C-27 to S-447; C-27 to G-446; C-27 to E-445; C-27 to S-444; C-27 to D-443; C-27 to G-442; C-27 to T-441; C-27 to G-440; C-27 to G-439; C-27 to G-438; C-27 to G-437; C-27 to S-436; C-27 to G-435; C-27 to A434; C-27 to Q-433; C-27 to G-432; C-27 to L-431; C-27 to R-430; C-27 to C-429; C-27 to H-428; C-27 to S-427; C-27 to R-426; C-27 to T-425; C-27 to R-424; C-27 to N-423; C-27 to K-422; C-27 to R-421; C-27 to S-420; C-27 to C-419; C-27 to G-418; C-27 to P-417; C-27 to R-416; C-27 to R-415; C-27 to R-414; C-27 to P-413; C-27 to G-412; C-27 to S-411; C-27 to T-410; C-27 to P-409; C-27 to F-408; C-27 to R-407; C-27 to T-406; C-27 to A405; C-27 to R-404; C-27 to L-403; C-27 to G-402; C-27 to R-401; C-27 to A400; C-27 to A-399; C-27 to S-398; C-27 to C-397; C-27 to H-396; C-27 to A-395; C-27 to P-394; C-27 to P-393; C-27 to E-392; C-27 to A-391; C-27 to S-390; C-27 to G-389; C-27 to P-388; C-27 to L-387; C-27 to T-386; C-27 to G-385; C-27 to F-384; C-27 to P-383; C-27 to S-382; C-27 to D-381; C-27 to N-380; C-27 to I-379; C-27 to H-378; C-27 to R-377; C-27 to P-376; C-27 to G-375; C-27 to S-374; C-27 to G-373; C-27 to N-372; C-27 to G-371; C-27 to P-370; C-27 to P-369; C-27 to S-368; C-27 to D-367; C-27 to G-366; C-27 to P-365; C-27 to P-364; C-27 to V-363; C-27 to R-362; C-27 to G-361; C-27 to K-360; C-27 to L-359; C-27 to A-358; C-27 to N-357; C-27 to G-356; C-27 to A-355; C-27 to S-354; C-27 to A-353; C-27 to P-352; C-27 to R-351; C-27 to G-350; C-27 to P-349; C-27 to E-348; C-27 to L-347; C-27 to V-346; C-27 to S-345; C-27 to A-344; C-27 to K-343; C-27 to D-342; C-27 to A-341; C-27 to A-340; C-27 to D-339; C-27 to P-338; C-27 to Q-337; C-27 to C-336; C-27 to C-335; C-27 to K-334; C-27 to P-333; C-27 to L-332; C-27 to G-331; C-27 to L-330; C-27 to P-329; C-27 to E-328; C-27 to E-327; C-27 to D-326; C-27 to T-325; C-27 to A-324; C-27 to R-323; C-27 to G-322; C-27 to T-321; C-27 to W-320; C-27 to I-319; C-27 to P-318; C-27 to H-317; C-27 to Y-316; C-27 to P-315; C-27 to G-314; C-27 to T-313; C-27 to A-312; C-27 to V-311; C-27 to A-310; C-27 to C-309; C-27 to G-308; C-27 to Q-307; C-27 to L-306; C-27 to D-305; C-27 to N-304; C-27 to A-303; C-27 to A-302; C-27 to L-301; C-27 to R-300; C-27 to K-299; C-27 to L-298; C-27 to D-297; C-27 to R-296; C-27 to G-295; C-27 to A-294; C-27 to L-293; C-27 to R-292; C-27 to Q-291; C-27 to P-290; C-27 to L-289; C-27 to S-288; C-27 to C-287; C-27 to P-286; C-27 to V-285; C-27 to E-284; C-27 to S-283; C-27 to S-282; C-27 to S-281; C-27 to G-280; C-27 to R-279; C-27 to F-278; C-27 to K-277; C-27 to Q-276; C-27 to L-275; C-27 to W-274; C-27 to A-273; C-27 to W-272; C-27 to L-271; C-27 to P-270; C-27 to R-269; C-27 to A-268; C-27 to R-267; C-27 to C-266; C-27 to D-265; C-27 to C-264; C-27 to V-263; C-27 to W-262; C-27 to P-261; C-27 to N-260; C-27 to D-259; C-27 to N-258; C-27 to L-257; C-27 to R-256; C-27 to L-255; C-27 to Y-254; C-27 to Q-253; C-27 to L-252; C-27 to A-251; C-27 to R-250; C-27 to L-249; C-27 to P-248; C-27 to A-247; C-27 to L-246; C-27 to A-245; C-27 to E-244; C-27 to T-243; C-27 to P-242; C-27 to L-241; C-27 to A-240; C-27 to S-239; C-27 to L-238; C-27 to N-237; C-27 to N-236; C-27 to A-235; C-27 to F-234; C-27 to L-233; C-27 to Y-232; C-27 to L-231; C-27 to T-230; C-27 to M-229; C-27 to L-228; C-27 to R-227; C-27 to G-226; C-27 to L-225; C-27 to D-224; C-27 to R-223; C-27 to F-222; C-27 to A-221; C-27 to H-220; C-27 to P-219; C-27 to H-218; C-27 to V-217; C-27 to H-216; C-27 to A-215; C-27 to V-214; C-27 to R-213; C-27 to N-212; C-27 to Q-211; C-27 to H-210; C-27 to L-209; C-27 to L-208; C-27 to L-207; C-27 to R-206; C-27 to D-205; C-27 to L-204; C-27 to S-203; C-27 to H-202; C-27 to L-201; C-27 to G-200; C-27 to R-199; C-27 to F-198; C-27 to A-197; C-27 to R-196; C-27 to E-195; C-27 to P-194; C-27 to V-193; C-27 to S-192; C-27 to S-191; C-27 to I-190; C-27 to R-189; C-27 to N-188; C-27 to G-187; C-27 to H-186; C-27 to L-185; C-27 to F-184; C-27 to L-183; C-27 to H-12; C-27 to T-181; C-27 to L-180; C-27 to N-179; C-27 to G-178; C-27 to L-177; C-27 to D-176; C-27 to R-175; C-27 to F-174; C-27 to T-173; C-27 to D-172; C-27 to D-171; C-27 to P-170; C-27 to L-169; C-27 to A-168; C-27 to Q-167; C-27 to L-166; C-27 to A-165; C-27 to N-164; C-27 to D-163; C-27 to Q-162; C-27 to L-161; C-27 to Y-160; C-27 to L-159; C-27 to Y-158; C-27 to Q-157; C-27 to L-156; C-27 to A-155; C-27 to A-154; C-27 to L-153; C-27 to G-152; C-27 to R-151; C-27 to F-150; C-27 to L-149; C-27 to G-148; C-27 to P-147; C-27 to G-146; C-27 to L-145; C-27 to E-144; C-27 to Q-143; C-27 to L-142; C-27 to G-141; C-27 to C-140; C-27 to R-139; C-27 to D-138; C-27 to L-137; C-27 to H-136; C-27 to L-135; C-27 to T-134; C-27 to H-133; C-27 to L-132; C-27 to R-131; C-27 to G-130; C-27 to L-129; C-27 to G-128; C-27 to H-127; C-27 to F-126; C-27 to T-125; C-27 to A-124; C-27 to P-123; C-27 to D-122; C-27 to V-121; C-27 to S-120; C-27 to R-119; C-27 to L-118; C-27 to Q-117; C-27 to A-116; C-27 to N-115; C-27 to D-114; C-27 to S-113; C-27 to L-112; C-27 to D-111; C-27 to L-110; C-27 to Q-109; C-27 to E-108; C-27 to L-107; C-27 to L-106; C-27 to A-105; C-27 to L-104; C-27 to G-103; C-27 to T-102; C-27 to F-101; C-27 to A-100; C-27 to A-99; C-27 to A-98; C-27 to D-97; C-27 to I-96; C-27 to R-95; C-27 to A-94; C-27 to L-93; C-27 to V-92; C-27 to N-91; C-27 to S-90; C-27 to H-89; C-27 to L-88; C-27 to W-87; C-27 to L-86; C-27 to I-85; C-27 to T-84; C-27 to L-83; C-27 to N-82; C-27 to R-81; C-27 to C-80; C-27 to A-79; C-27 to R-78; C-27 to F-77; C-27 to S-76; C-27 to A-75; C-27 to A-74; C-27 to P-73; C-27 to V-72; C-27 to H-71; C-27 to S-70; C-27 to I-69; C-27 to R-68; C-27 to N-67; C-27 to G-66; C-27 to H-65; C-27 to L-64; C-27 to F-63; C-27 to I-62; C-27 to R-61; C-27 to Q-60; C-27 to S-59; C-27 to A-58; C-27 to A-57; C-27 to P-56; C-27 to I-55; C-27 to G-54; C-27 to V-53; C-27 to P-52; C-27 to V-51; C-27 to A-50; C-27 to Q-49; C-27 to L-48; C-27 to G-47; C-27 to Q-46; C-27 to Q-45; C-27 to P-44; C-27 to C-43; C-27 to S-42; C-27 to T-41; C-27 to T-40; C-27 to V-39; C-27 to K-38; C-27 to P-37; C-27 to E-36; C-27 to N-35; C-27 to Y-34; and/or C-27 to C-33 of the amino acid sequence of SEQ ID NO:2.

The invention also provides antibodies that bind polypeptides having one or more amino acids deleted from both the amino and the carboxyl termini of a NogoR polypeptide, which may be described generally as having residues $n^1$-$m^1$ of SEQ ID NO:2, where $n^1$ and $m^1$ are integers as described above.

It will be recognized in the art that some amino acid sequence of NogoR can be varied without significant effect of the structure or function of the protein. If such differences in sequence are contemplated, it should be remembered that there will be critical areas on the protein which determine activity. Such areas will usually comprise residues which make up the ligand binding site or the death domain, or which form tertiary structures which affect these domains.

Thus, the invention further includes antibodies that bind variations of the NogoR protein which show substantial NogoR protein activity or which include regions of NogoR such as the protein fragments discussed below. Such mutants include deletions, insertions, inversions, repeats, and type substitution. Guidance concerning which amino acid changes are likely to be phenotypically silent can be found in Bowie et al., *Science* 247:1306-1310 (1990).

Thus, antibodies of the present invention may bind a fragment, derivative, or analog of the polypeptide of SEQ ID NO:2. Such fragments, variants or derivatives may be (i) one in which at least one or more of the amino acid residues are substituted with a conserved or non-conserved amino acid residue (preferably a conserved amino acid residue(s), and more preferably at least one but less than ten conserved amino acid residues) and such substituted amino acid residue may or may not be one encoded by the genetic code, or (ii) one in which one or more of the amino acid residues includes a substituent group, or (iii) one in which the mature polypeptide is fused with another compound, such as a compound to increase the half-life of the polypeptide (for example, polyethylene glycol), or (iv) one in which the additional amino acids are fused to the mature polypeptide, such as an IgG Fc fusion region peptide or leader or secretory sequence or a sequence which is employed for purification of the mature polypeptide or a proprotein sequence. Such fragments, derivatives and analogs are deemed to be within the scope of those skilled in the art from the teachings herein.

Of particular interest are substitutions of charged amino acids with another charged amino acid and with neutral or negatively charged amino acids. The latter results in proteins with reduced positive charge to improve the characteristics of the NogoR protein. The prevention of aggregation is highly desirable. Aggregation of proteins not only results in a loss of activity but can also be problematic when preparing pharmaceutical formulations, because they can be immunogenic (Pinckard et al., *Clin Exp Immunol* 2:331-340 (1967); Robbins et al., *Diabetes* 36:838-845 (1987); Cleland et al., *Crit Rev Ther Drug Carrier Syst* 10:307-377 (1993)).

The replacement of amino acids can also change the selectivity of binding to cell surface receptors. Ostade et al., *Nature* 361:266-268 (1993) describes certain mutations resulting in selective binding of TNF-alpha to only one of the two known types of TNF receptors. Thus, the antibodies of the present invention may bind a NogoR polypeptide that contains one or more amino acid substitutions, deletions or additions, either from natural mutations or human manipulation.

As indicated, changes are preferably of a minor nature, such as conservative amino acid substitutions that do not significantly affect the folding or activity of the protein (see Table 3).

TABLE 3

Conservative Amino Acid Substitutions.

| | |
|---|---|
| Aromatic | Phenylalanine |
| | Tryptophan |
| | Tyrosine |
| Hydrophobic | Leucine |
| | Isoleucine |
| | Valine |
| Polar | Glutamine |
| | Asparagine |
| Basic | Arginine |
| | Lysine |
| | Histidine |
| Acidic | Aspartic Acid |
| | Glutamic Acid |
| Small | Alanine |
| | Serine |
| | Threonine |
| | Methionine |
| | Glycine |

In specific embodiments, the number of substitutions, additions or deletions in the amino acid sequence of SEQ ID NO:2 and/or any of the polypeptides or polypeptide fragments described herein is 40, 35, 30, 25, 20, 15, 10, 9, 8, 7, 6, 5, 4, 3, 2, 1 or 30-20, 20-15, 20-10, 15-10, 10-1, 5-10, 1-5, 1-3 or 1-2.

In specific embodiments, the antibodies of the invention bind the NogoR polypeptides or fragments or variants thereof that contains any one or more of the following conservative mutations in NogoR: M1 replaced with A, G, I, L, S, T, or V; K2 replaced with H, or R; R3 replaced with H, or K; A4 replaced with G, I, L, S, T, M, or V; S5 replaced with A, G, I, L, T, M, or V; A6 replaced with G, I, L, S, T, M, or V; G7 replaced with A, I, L, S, T, M, or V; G8 replaced with A, I, L, S, T, M, or V; S9 replaced with A, G, I, L, T, M, or V; R10 replaced with H, or K; L11 replaced with A, G, I, S, T, M, or V; L12 replaced with A, G, I, S, T, M, or V; A13 replaced with G, I, L, S, T, M, or V; W14 replaced with F, or Y; V15 replaced with A, G, I, L, S, T, or M; L16 replaced with A, G, I, S, T, M, or V; W17 replaced with F, or Y; L18 replaced with A, G, I, S, T, M, or V; Q19 replaced with N; A20 replaced with G, I, L, S, T, M, or V; W21 replaced with F, or Y; Q22 replaced with N; V23 replaced with A, G, I, L, S, T, or M; A24 replaced with G, I, L, S, T, M, or V; A25 replaced with G, I, L, S, T, M, or V; G29 replaced with A, I, L, S, T, M, or V; A30 replaced with G, I, L, S, T, M, or V; V32 replaced with A, G, I, L, S, T, or M; Y34 replaced with F, or W; N35 replaced with Q; E36 replaced with D; K38 replaced with H, or R; V39 replaced with A, G, I, L, S, T, or M; T40 replaced with A, G, I, L, S, M, or V; T41 replaced with A, G, I, L, S, M, or V; S42 replaced with A, G, I, L, T, M, or V; Q45 replaced with N; Q46 replaced with N; G47 replaced with A, I, L, S, T, M, or V; L48 replaced with A, G, I, S, T, M, or V; Q49 replaced with N; A50 replaced with G, I, L, S, T, M, or V; V51 replaced with A, G, I, L, S, T, or M; V53 replaced with A, G, I, L, S, T, or M; G54 replaced with A, I, L, S, T, M, or V; I55 replaced with A, G, L, S, T, M, or V; A57 replaced with G, I, L, S, T, M, or V; A58 replaced with G, I, L, S, T, M, or V; S59 replaced with A, G, I, L, T, M, or V; Q60 replaced with N; R61 replaced with H, or K; I62 replaced with A, G, L, S, T, M, or V; F63 replaced with W, or Y; L64 replaced with A, G, I, S, T, M, or V; H65 replaced with K, or R; G66 replaced with A, I, L, S, T, M, or V; N67 replaced with Q; R68 replaced with H, or K; I69 replaced with A, G, L, S, T, M, or V; S70 replaced with A, G, I, L, T, M, or V; H71 replaced with K, or R; V72 replaced with A, G, I, L, S, T, or M; A74 replaced with G, I, L, S, T, M, or V; A75 replaced with G, I, L, S, T, M, or V; S76 replaced with A, G, I, L, T, M, or V; F77 replaced with W, or Y; R78 replaced with H, or K; A79 replaced with G, I, L, S, T, M, or V; R81 replaced with H, or K; N82 replaced with Q; L83 replaced with A, G, I, S, T, M, or V; T84 replaced with A, G, I, L, S, M, or V; I85 replaced with A, G, L, S, T, M, or V; L86 replaced with A, G, I, S, T, M, or V; W87 replaced with F, or Y; L88 replaced with A, G, I, S, T, M, or V; H89 replaced with K, or R; S90 replaced with A, G, I, L, T, M, or V; N91 replaced with Q; V92 replaced with A, G, I, L, S, T, or M; L93 replaced with A, G, I, S, T, M, or V; A94 replaced with G, I, L, S, T, M, or V; R95 replaced with H, or K; I96 replaced with A, G, L, S, T, M, or V; D97 replaced with E; A98 replaced with G, I, L, S, T, M, or V; A99 replaced with G, I, L, S, T, M, or V; A100 replaced with G, I, L, S, T, M, or V; F101 replaced with W, or Y; T102 replaced with A, G, I, L, S, M, or V; G103 replaced with A, I, L, S, T, M, or V; L104 replaced with A, G, I, S, T, M, or V; A105 replaced with G, I, L, S, T, M, or V; L106 replaced with A, G, I, S, T, M, or V; L107 replaced with A, G, I, S, T, M, or V; E108 replaced with D; Q109 replaced with N; L110 replaced with A, G, I, S, T, M, or V; D111 replaced with E; L112 replaced with A, G, I, S, T, M, or V; S113 replaced with A, G, I, L, T, M, or V; D114 replaced with E; N115 replaced with Q; A116 replaced with G, I, L, S, T, M, or V; Q117 replaced with N; L118 replaced with A, G, I, S, T, M, or V; R119 replaced with H, or K; S120 replaced with A, G, I, L, T, M, or V; V121 replaced with A, G, I, L, S, T, or M; D122 replaced with E; A124 replaced with G, I, L, S, T, M, or V; T125 replaced with A, G, I, L, S, M, or V; F126 replaced with W, or Y; H127 replaced with K, or R; G128 replaced with A, I, L, S, T, M, or V; L129 replaced with A, G, I, S, T, M, or V; G130 replaced with A, I, L, S, T, M, or V; R131 replaced with H, or K; L132 replaced with A, G, I, S, T, M, or V; H133 replaced with K, or R; T134 replaced with A, G, I, L, S, M, or V; L135 replaced with A, G, I, S, T, M, or V; H136 replaced with K, or R; L137 replaced with A, G, I, S, T, M, or V; D138 replaced with E; R139 replaced with H, or K; G141 replaced with A, I, L, S, T, M, or V; L142 replaced with A, G, I, S, T, M, or V; Q143 replaced with N; E144 replaced with D; L145 replaced with A, G, I, S, T, M, or V; G146 replaced with A, I, L, S, T, M, or V; G148 replaced with A, I, L, S, T, M, or V; L149 replaced with A, G, I, S, T, M, or V; F150 replaced with W, or Y; R151 replaced with H, or K; G152 replaced with A, I, L, S, T, M, or V; L153 replaced with A, G, I, S, T, M, or V; A154 replaced with G, I, L, S, T, M, or V; A155 replaced with G, I, L, S, T, M, or V; L156 replaced with A, G, I, S, T, M, or V; Q157 replaced with N; Y158 replaced with F, or W; L159 replaced with A, G, I, S, T, M, or V; Y160 replaced with F, or W; L161 replaced with A, G, I, S, T, M, or V; Q162 replaced with N; D163 replaced with E; N164 replaced with Q; A165 replaced with G, I, L, S, T, M, or V; L166 replaced with A, G, I, S, T, M, or V; Q167 replaced with N; A168 replaced with G, I, L, S, T, M, or V; L169 replaced with A, G, I, S, T, M, or V; D171 replaced with E; D172 replaced with E; T173 replaced with A, G, I, L, S, M, or V; F174 replaced with W, or Y; R175 replaced with H, or K; D176 replaced with E; L177 replaced with A, G, I, S, T, M, or V; G178 replaced with A, I, L, S, T, M, or V; N179 replaced with Q; L180 replaced with A, G, I, S, T, M, or V; T181 replaced with A, G, I, L, S, M, or V; H182 replaced with K, or R; L183 replaced with A, G, I, S, T, M, or V; F184 replaced with W, or Y; L185 replaced with A, G, I, S, T, M, or V; H186 replaced with K, or R; G187 replaced with A, I, L, S, T, M, or V; N188 replaced with Q; R189 replaced with H, or K; I190 replaced with A, G, L, S, T, M, or V; S191 replaced with A, G, I, L, T, M, or V; S192 replaced with A, G, I, L, T, M, or V; V193 replaced with A, G, I, L, S, T, or M; E195 replaced with D; R196 replaced with H, or K; A197 replaced with G, I, L, S, T, M, or V; F198 replaced with W, or Y; R199 replaced with H, or K; G200 replaced with A, I, L, S, T, M, or V; L201 replaced with A, G, I, S, T, M, or V; H202 replaced with K, or R; S203 replaced with A, G, I, L, T, M, or V; L204 replaced with A, G, I, S, T, M, or V; D205 replaced with E; R206 replaced with H, or K; L207 replaced with A, G, I, S, T, M, or V; L208 replaced with A, G, I, S, T, M, or V; L209 replaced with A, G, I, S, T, M, or V; H210 replaced with K, or R; Q211 replaced with N; N212 replaced with Q; R213 replaced with H, or K; V214 replaced with A, G, I, L, S, T, or M; A215 replaced with G, I, L, S, T, M, or V; H216 replaced with K, or R; V217 replaced with A, G, I, L, S, T, or M; H218 replaced with K, or R; H220 replaced with K, or R; A221 replaced with G, I, L, S, T, M, or V; F222 replaced with W, or Y; R223 replaced with H, or K; D224 replaced with E; L225 replaced with A, G, I, S, T, M, or V; G226 replaced with A, I, L, S, T, M, or V; R227 replaced with H, or K; L228 replaced with A, G, I, S, T, M, or V; M229 replaced with A, G, I, L, S, T, or V; T230 replaced with A, G, I, L, S, M, or V; L231 replaced with A, G, I, S, T, M, or V; Y232 replaced with F, or W; L233 replaced with A, G, I, S, T, M, or V; F234 replaced with W, or Y; A235 replaced with G, I, L, S, T, M, or V; N236 replaced with Q; N237 replaced with Q; L238 replaced with A, G, I, S, T, M, or V; S239 replaced with A, G, I, L, T, M, or V; A240 replaced with G, I, L, S, T, M, or V; L241 replaced with A, G, I, S, T, M, or V; T243 replaced with A, G, I, L, S, M, or V; E244 replaced with D; A245 replaced with G, I, L, S, T, M, or V; L246 replaced with A, G, I, S, T, M, or V; A247 replaced with G, I, L, S, T, M, or V; L249 replaced with A, G, I, S, T, M, or V; R250 replaced with H, or K; A251 replaced with G, I, L, S, T, M, or V; L252 replaced with A, G, I, S, T, M, or V; Q253 replaced with N; Y254 replaced with F, or W; L255 replaced with A, G, I, S, T, M, or V; R256 replaced with H, or K; L257 replaced with A, G, I, S, T, M, or V; N258 replaced with Q; D259 replaced with E; N260 replaced with Q; W262 replaced with F, or Y; V263 replaced with A, G, I, L, S, T, or M; D265 replaced with E; R267 replaced with H, or K; A268 replaced with G, I, L, S, T, M, or V; R269 replaced with H, or K; L271 replaced with A, G, I, S, T, M, or V; W272 replaced with F, or Y; A273 replaced with G, I, L, S, T, M, or V; W274 replaced with F, or Y; L275 replaced with A, G, I, S, T, M, or V; Q276 replaced with N; K277 replaced with H, or R; F278 replaced with W, or Y; R279 replaced with H, or K; G280 replaced with A, I, L, S, T, M, or V; S281 replaced with A, G, I, L, T, M, or V; S282 replaced with A, G, I, L, T, M, or V; S283 replaced with A, G, I, L, T, M, or V; E284 replaced with D; V285 replaced with A, G, I, L, S, T, or M; S288 replaced with A, G, I, L, T, M, or V; I289 replaced with A, G, I, S, T, M, or V; Q291 replaced with N; R292 replaced with H, or K; L293 replaced with A, G, I, S, T, M, or V; A294 replaced with G, I, L, S, T, M, or V; G295 replaced with A, I, L, S, T, M, or V; R296 replaced with H, or K; D297 replaced with E; L298 replaced with A, G, I, S, T, M, or V; K299 replaced with H, or R; R300 replaced with H, or K; L301 replaced with A, G, I, S, T, M, or V; A302 replaced with G, I, L, S, T, M, or V; A303 replaced with G, I, L, S, T, M, or V; N304 replaced with Q; D305 replaced with E; L306 replaced with A, G, I, S, T, M, or V; Q307 replaced with N; G308 replaced with A, I, L, S, T, M, or V; A310 replaced with G, I, L, S, T, M, or V; V311 replaced with A, G, I, L, S, T, or M; A312 replaced with G, I, L, S, T, M, or V; T313 replaced with A, G, I, L, S, M, or V; G314 replaced with A, I, L, S, T, M, or V; Y316 replaced with F, or W; H317 replaced with K, or R; I319 replaced with A, G, L, S, T, M, or V; W320 replaced with F, or Y; T321 replaced with A, G, I, L, S, M, or V; G322 replaced with A, I, L, S, T, M, or V; R323 replaced with H, or K; A324 replaced with G, I, L, S, T, M, or V; T325 replaced with A, G, I, L, S, M, or V; D326 replaced with E; E327 replaced with D; E328 replaced with D; L330 replaced with A, G, I, S, T, M, or V; G331 replaced with A, I, L, S, T, M, or V; L332 replaced with A, G, I, S, T, M, or V; K334 replaced with H, or R; Q337 replaced with N; D339 replaced with E; A340 replaced with G, I, L, S, T, M, or V; A341 replaced with G, I, L, S, T, M, or V; D342 replaced with E; K343 replaced with H, or R; A344 replaced with G, I, L, S, T, M, or V; S345 replaced with A, G, I, L, T, M, or V; V346 replaced with A, G, I, L, S, T, or M; L347 replaced with A, G, I, S, T, M, or V; E348 replaced with D; G350 replaced with A, I, L, S, T, M, or V; R351 replaced with H, or K; A353 replaced with G, I, L, S, T, M, or V; S354 replaced with A, G, I, L, T, M, or V; A355 replaced with G, I, L, S, T, M, or V; G356 replaced with A, I, L, S, T, M, or V; N357 replaced with Q; A358 replaced with G, I, L, S, T, M, or V; L359 replaced with A, G, I, S, T, M, or V; K360 replaced with H, or R; G361 replaced with A, I, L, S, T, M, or V; R362 replaced with H, or K; V363 replaced with A, G, I, L, S, T, or M; G366 replaced with A, I, L, S, T, M, or V; D367 replaced with E; S368 replaced with A, G, I, L, T, M, or V; G371 replaced with A, I, L, S, T, M, or V; N372 replaced with Q; G373 replaced with A, I, L, S, T, M, or V; S374 replaced with A, G, I, L, T, M, or V; G375 replaced with A, I, L, S, T, M, or V; R377 replaced with H, or K; H378 replaced with K, or R; I379 replaced with A, G, L, S, T, M, or V; N380 replaced with Q; D381 replaced with E; S382 replaced with A, G, I, L, T, M, or V; F384 replaced with W, or Y; G385 replaced with A, I, L, S, T, M, or V; T386 replaced with A, G, I, L, S, M, or V; L387 replaced with A, G, I, S, T, M, or V; G389 replaced with A, I, L, S, T, M, or V; S390 replaced with A, G, I, L, T, M, or V; A391 replaced with G, I, L, S, T, M, or V; E392 replaced with D; A395 replaced with G, I, L, S, T, M, or V; H396 replaced with K, or R; S398 replaced with A, G, I, L, T, M, or V; A399 replaced with G, I, L, S, T, M, or V; A400 replaced with G, I, L, S, T, M, or V; R401 replaced with H, or K; G402 replaced with A, I, L, S, T, M, or V; L403 replaced with A, G, I, S, T, M, or V; R404 replaced with H, or K; A405 replaced with G, I, L, S, T, M, or V; T406 replaced with A, G, I, L, S, M, or V; R407 replaced with H, or K; F408 replaced with W, or Y; T410 replaced with A, G, I, L, S, M, or V; S411 replaced with A, G, I, L, T, M, or V; G412 replaced with A, I, L, S, T, M, or V; R414 replaced with H, or K; R415 replaced with H, or K; R416 replaced with H, or K; G418 replaced with A, I, L, S, T, M, or V; S420 replaced with A, G, I, L, T, M, or V; R421 replaced with H, or K; K422 replaced with H, or R; N423 replaced with Q; R424 replaced with H, or K; T425 replaced with A, G, I, L, S, M, or V; R426 replaced with H, or K; S427 replaced with A, G, I, L, T, M, or V; H428 replaced with K, or R; R430 replaced with H, or K; L431 replaced with A, G, I, S, T, M, or V; G432 replaced with A, I, L, S, T, M, or V; Q433 replaced with N; A434 replaced with G, I, L, S, T, M, or V; G435 replaced with A, I, L, S, T, M, or V; S436 replaced with A, G, I, L, T, M, or V; G437 replaced with A, I, L, S, T, M, or V; G438 replaced with A, I, L, S T, M, or V; G439 replaced with A, I, L, S, T, M, or V; G440 replaced with A, I, L, S, T, M, or V; T441 replaced with A, G, I, L, S, M, or V; G442 replaced with A, I, L, S, T, M, or V; D443 replaced with E; S444 replaced with A, G, I, L, T, M, or V; E445 replaced with D; G446 replaced with A, I, L, S, T, M, or V; S447 replaced with A, G, I, L, T, M, or V; G448 replaced with A, I, L, S, T, M, or V; A449 replaced with G, I, L, S, T, M, or V; L450 replaced with A, G, I, S, T, M, or V; S452 replaced with A, G, I, L, T, M, or V; L453 replaced with A, G, I, S, T, M, or V; T454 replaced with A, G, I, L, S, M, or V; S456 replaced with A, G, I, L, T, M, or V; L457 replaced with A, G, I, S, T, M, or V; T458 replaced with A, G, I, L, S, M, or V; L460 replaced with A, G, I, S, T, M, or V; G461 replaced with A, I, L, S, T, M, or V; L462 replaced with A, G, I, S, T, M, or V; A463 replaced with G, I, L, S, T, M, or V; L464 replaced with A, G, I, S, T, M, or V; V465 replaced with A, G, I, L, S, T, or M; L466 replaced with A, G, I, S, T, M, or V; W467 replaced with F, or Y; T468 replaced with A, G, I, L, S, M, or V; V469 replaced with A, G, I, L, S, T, or M; L470 replaced with A, G, I, S, T, M, or V; G471 replaced with A, I, L, S, T, M, or V; of SEQ ID NO:2.

In specific embodiments, the antibodies of the invention bind the NogoR polypeptides or fragments or variants thereof, that contains any one or more of the following non-conservative mutations in NogoR: M1 replaced with D, E, H, K, R, N, Q, F, W, Y, P, or C; K2 replaced with D, E, A, G, I, L, S, T, M, V, N, Q, F, W, Y, P, or C; R3 replaced with D, E, A, G, I, L, S, T, M, V, N, Q, F, W, Y, P, or C; A4 replaced with D, E, H, K, R, N, Q, F, W, Y, P, or C; S5 replaced with D, E, H, K, R, N, Q, F, W, Y, P, or C; A6 replaced with D, E, H, K, R, N, Q, F, W, Y, P, or C; G7 replaced with D, E, H, K, R, N, Q, F, W, Y, P, or C; G8 replaced with D, E, H, K, R, N, Q, F, W, Y, P, or C; S9 replaced with D, E, H, K, R, N, Q, F, W, Y, P, or C; R10 replaced with D, E, A, G, I, L, S, T, M, V, N, Q, F, W, Y, P, or C; L11 replaced with D, E, H, K, R, N, Q, F, W, Y, P, or C; L12 replaced with D, E, H, K, R, N, Q, F, W, Y, P, or C; A13 replaced with D, E, H, K, R, N, Q, F, W, Y, P, or C; W14 replaced with D, E, H, K, R, N, Q, A, G, I, L, S, T, M, V, P, or C; V15 replaced with D, E, H, K, R, N, Q, F, W, Y, P, or C; L16 replaced with D, E, H, K, R, N, Q, F, W, Y, P, or C; W17 replaced with D, E, H, K, R, N, Q, A, G, I, L, S, T, M, V, P, or C; L18 replaced with D, E, H, K, R, N, Q, F, W, Y, P, or C; Q19 replaced with D, E, H, K, R, A, G, I, L, S, T, M, V, F, W, Y, P, or C; A20 replaced with D, E, H, K, R, N, Q, F, W, Y, P, or C; W21 replaced with D, E, H, K, R, N, Q, A, G, I, L, S, T, M, V, P, or C; Q22 replaced with D, E, H, K, R, A, G, I, L, S, T, M, V, F, W, Y, P, or C; V23 replaced with D, E, H, K, R, N, Q, F, W, Y, P, or C; A24 replaced with D, E, H, K, R, N, Q, F, W, Y, P, or C; A25 replaced with D, E, H, K, R, N, Q, F, W, Y, P, or C; P26 replaced with D, E, H, K, R, A, G, I, L, S, T, M, V, N, Q, F, W, Y, or C; C27 replaced with D, E, H, K, R, A, G, I, L, S, T, M, V, N, Q, F, W, Y, or P; P28 replaced with D, E, H, K, R, A, G, I, L, S, T, M, V, N, Q, F, W, Y, or C; G29 replaced with D, E, H, K, R, N, Q, F, W, Y, P, or C; A30 replaced with D, E, H, K, R, N, Q, F, W, Y, P, or C; C31 replaced with D, E, H, K, R, A, G, I, L, S, T, M, V, N, Q, F, W, Y, or P; V32 replaced with D, E, H, K, R, N, Q, F, W, Y, P, or C; C33 replaced with D, E, H, K, R, A, G, I, L, S, T, M, V, N, Q, F, W, Y, or P; Y34 replaced with D, E, H, K, R, N, Q, A, G, I, L, S, T, M, V, P, or C; N35 replaced with D, E, H, K, R, A, G, I, L, S, T, M, V, F, W, Y, P, or C; E36 replaced with H, K, R, A, G, I, L, S, T, M, V, N, Q, F, W, Y, P, or C; P37 replaced with D, E, H, K, R, A, G, I, L, S, T, M, V, N, Q, F, W, Y, or C; K38 replaced with D, E, A, G, I, L, S, T, M, V, N, Q, F, W, Y, P, or C; V39 replaced with D, E, H, K, R, N, Q, F, W, Y, P, or C; T40 replaced with D, E, H, K, R, N, Q, F, W, Y, P, or C; T41 replaced with D, E, H, K, R, N, Q, F, W, Y, P, or C; S42 replaced with D, E, H, K, R, N, Q, F, W, Y, P, or C; C43 replaced with D, E, H, K, R, A, G, I, L, S, T, M, V, N, Q, F, W, Y, or P; P44 replaced with D, E, H, K, R, A, G, I, L, S, T, M, V, N, Q, F, W, Y, or C; Q45 replaced with D, E, H, K, R, A, G, I, L, S, T, M, V, F, W, Y, P, or C; Q46 replaced with D, E, H, K, R, A, G, I, L, S, T, M, V, F, W, Y, P, or C; G47 replaced with D, E, H, K, R, N, Q, F, W, Y, P, or C; L48 replaced with D, E, H, K, R, N, Q, F, W, Y, P, or C; Q49 replaced with D, E, H, K, R, A, G, I, L, S, T, M, V, F, W, Y, P, or C; A50 replaced with D, E, H, K, R, N, Q, F, W, Y, P, or C; V51 replaced with D, E, H, K, R, N, Q, F, W, Y, P, or C; P52 replaced with D, E, H, K, R, A, G, I, L, S, T, M, V, N, Q, F, W, Y, or C; V53 replaced with D, E, H, K, R, N, Q, F, W, Y, P, or C; G54 replaced with D, E, H, K, R, N, Q, F, W, Y, P, or C; I55 replaced with D, E, H, K, R, N, Q, F, W, Y, P, or C; P56 replaced with D, E, H, K, R, A, G, I, L, S, T, M, V, N, Q, F, W, Y, or C; A57 replaced with D, E, H, K, R, N, Q, F, W, Y, P, or C; A58 replaced with D, E, H, K, R, N, Q, F, W, Y, P, or C; S59 replaced with D, E, H, K, R, N, Q, F, W, Y, P, or C; Q60 replaced with D, E, H, K, R, A, G, I, L, S, T, M, V, F, W, Y, P, or C; R61 replaced with D, E, A, G, I, L, S, T, M, V, N, Q, F, W, Y, P, or C; I62 replaced with D, E, H, K, R, N, Q, F, W, Y, P, or C; F63 replaced with D, E, H, K, R, N, Q, A, G, I, L, S, T, M, V, P, or C; L64 replaced with D, E, H, K, R, N, Q, F, W, Y, P, or C; H65 replaced with D, E, A, G, I, L, S, T, M, V, N, Q, F, W, Y, P, or C; G66 replaced with D, E, H, K, R, N, Q, F, W, Y, P, or C; N67 replaced with D, E, H, K, R, A, G, I, L, S, T, M, V, F, W, Y, P, or C; R68 replaced with D, E, A, G, I, L, S, T, M, V, N, Q, F, W, Y, P, or C; I69 replaced with D, E, H, K, R, N, Q, F, W, Y, P, or C; S70 replaced with D, E, H, K, R, N, Q, F, W, Y, P, or C; H71 replaced with D, E, A, G, I, L, S, T, M, V, N, Q, F, W, Y, P, or C; V72 replaced with D, E, H, K, R, N, Q, F, W, Y, P, or C; P73 replaced with D, E, H, K, R, A, G, I, L, S, T, M, V, N, Q, F, W, Y, or C; A74 replaced with D, E, H, K, R, N, Q, F, W, Y, P, or C; A75 replaced with D, E, H, K, R, N, Q, F, W, Y, P, or C; S76 replaced with D, E, H, K, R, N, Q, F, W, Y, P, or C; F77 replaced with D, E, H, K, R, N, Q, A, G, I, L, S, T, M, V, P, or C; R78 replaced with D, E, A, G, I, L, S, T, M, V, N, Q, F, W, Y, P, or C; A79 replaced with D, E, H, K, R, N, Q, F, W, Y, P, or C; C80 replaced with D, E, H, K, R, A, G, I, L, S, T, M, V, N, Q, F, W, Y, or P; R81 replaced with D, E, A, G, I, L, S, T, M, V, N, Q, F, W, Y, P, or C; N82 replaced with D, E, H, K, R, A, G, I, L, S, T, M, V, F, W, Y, P, or C; L83 replaced with D, E, H, K, R, N, Q, F, W, Y, P, or C; T84 replaced with D, E, H, K, R, N, Q, F, W, Y, P, or C; I85 replaced with D, E, H, K, R, N, Q, F, W, Y, P, or C; L86 replaced with D, E, H, K, R, N, Q, F, W, Y, P, or C; W87 replaced with D, E, H, K, R, N, Q, A, G, I, L, S, T, M, V, P, or C; L88 replaced with D, E, H, K, R, N, Q, F, W, Y, P, or C; H89 replaced with D, E, A, G, I, L, S, T, M, V, N, Q, F, W, Y, P, or C; S90 replaced with D, E, H, K, R, N, Q, F, W, Y, P, or C; N91 replaced with D, E, H, K, R, A, G, I, L, S, T, M, V, F, W, Y, P, or C; V92 replaced with D, E, H, K, R, N, Q, F, W, Y, P, or C; L93 replaced with D, E, H, K, R, N, Q, F, W, Y, P, or C; A94 replaced with D, E, H, K, R, N, Q, F, W, Y, P, or C; R95 replaced with D, E, A, G, I, L, S, T, M, V, N, Q, F, W, Y, P, or C; I96 replaced with D, E, H, K, R, N, Q, F, W, Y, P, or C; D97 replaced with H, K, R, A, G, I, L, S, T, M, V, N, Q, F, W, Y, P, or C; A98 replaced with D, E, H, K, R, N, Q, F, W, Y, P, or C; A99 replaced with D, E, H, K, R, N, Q, F, W, Y, P, or C; A100 replaced with D, E, H, K, R, N, Q, F, W, Y, P, or C; F101 replaced with D, E, H, K, R, N, Q, A, G, I, L, S, T, M, V, P, or C; T102 replaced with D, E, H, K, R, N, Q, F, W, Y, P, or C; G103 replaced with D, E, H, K, R, N, Q, F, W, Y, P, or C; L104 replaced with D, E, H, K, R, N, Q, F, W, Y, P, or C; A105 replaced with D, E, H, K, R, N, Q, F, W, Y, P, or C; L106 replaced with D, E, H, K, R, N, Q, F, W, Y, P, or C; L107 replaced with D, E, H, K, R, N, Q, F, W, Y, P, or C; E108 replaced with H, K, R, A, G, I, L, S, T, M, V, N, Q, F, W, Y, P, or C; Q109 replaced with D, E, H, K, R, A, G, I, L, S, T, M, V, F, W, Y, P, or C; L110 replaced with D, E, H, K, R, N, Q, F, W, Y, P, or C; D111 replaced with H, K, R, A, G, I, L, S, T, M, V, N, Q, F, W, Y, P, or C; L112 replaced with D, E, H, K, R, N, Q, F, W, Y, P, or C; S113 replaced with D, E, H, K, R, N, Q, F, W, Y, P, or C; D114 replaced with H, K, R, A, G, I, L, S, T, M, V, N, Q, F, W, Y, P, or C; N115 replaced with D, E, H, K, R, A, G, I, L, S, T, M, V, F, W, Y, P, or C; A116 replaced with D, E, H, K, R, N, Q, F, W, Y, P, or C; Q117 replaced with D, E, H, K, R, A, G, I, L, S, T, M, V, F, W, Y, P, or C; L118 replaced with D, E, H, K, R, N, Q, F, W, Y, P, or C; R119 replaced with D, E, A, G, I, L, S, T, M, V, N, Q, F, W, Y, P, or C; S120 replaced with D, E, H, K, R, N, Q, F, W, Y, P, or C; V121 replaced with D, E, H, K, R, N, Q, F, W, Y, P, or C; D122 replaced with H, K, R, A, G, I, L, S, T, M, V, N, Q, F, W, Y, P, or C; P123 replaced with D, E, H, K, R, A, G, I, L, S, T, M, V, N, Q, F, W, Y, or C; A124 replaced with D, E, H, K, R, N, Q, F, W, Y, P, or C; T125 replaced with D, E, H, K, R, N, Q, F, W, Y, P, or C; F126 replaced with D, E, H, K, R, N, Q, A, G, I, L, S, T, M, V, P, or C; H127 replaced with D, E, A, G, I, L, S, T, M, V, N, Q, F, W, Y, P, or C; G128 replaced with D, E, H, K, R, N, Q, F, W, Y, P, or C; L129 replaced with D, E, H, K, R, N, Q, F, W, Y, P, or C; G130 replaced with D, E, H, K, R, N, Q, F, W, Y, P, or C; R131 replaced with D, E, A, G, I, L, S, T, M, V, N, Q, F, W, Y, P, or C; L132 replaced with D, E, H, K, R, N, Q, F, W, Y, P, or C; H133 replaced with D, E, A, G, I, L, S, T, M, V, N, Q, F, W, Y, P, or C; T134 replaced with D, E, H, K, R, N, Q, F, W, Y, P, or C; L135 replaced with D, E, H, K, R, N, Q, F, W, Y, P, or C; H136 replaced with D, E, A, G, I, L, S, T, M, V, N, Q, F, W, Y, P, or C; L137 replaced with D, E, H, K, R, N, Q, F, W, Y, P, or C; D138 replaced with H, K, R, A, G, I, L, S, T, M, V, N, Q, F, W, Y, P, or C; R139 replaced with D, E, A, G, I, L, S, T, M, V, N, Q, F, W, Y, P, or C; C140 replaced with D, E, H, K, R, A, G, I, L, S, T, M, V, N, Q, F, W, Y, or P; G141 replaced with D, E, H, K, R, N, Q, F, W, Y, P, or C; L142 replaced with D, E, H, K, R, N, Q, F, W, Y, P, or C; Q143 replaced with D, E, H, K, R, A, G, I, L, S, T, M, V, F, W, Y, P, or C; E144 replaced with H, K, R, A, G, I, L, S, T, M, V, N, Q, F, W, Y, P, or C; L145 replaced with D, E, H, K, R, N, Q, F, W, Y, P, or C; G146 replaced with D, E, H, K, R, N, Q, F, W, Y, P, or C; P147 replaced with D, E, H, K, R, A, G, I, L, S, T, M, V, N, Q, F, W, Y, or C; G148 replaced with D, E, H, K, R, N, Q, F, W, Y, P, or C; L149 replaced with D, E, H, K, R, N, Q, F, W, Y, P, or C; F150 replaced with D, E, H, K, R, N, Q, A, G, I, L, S, T, M, V, P, or C; R151 replaced with D, E, A, G, I, L, S, T, M, V, N, Q, F, W, Y, P, or C; G152 replaced with D, E, H, K, R, N, Q, F, W, Y, P, or C; L153 replaced with D, E, H, K, R, N, Q, F, W, Y, P, or C; A154 replaced with D, E, H, K, R, N, Q, F, W, Y, P, or C; A155 replaced with D, E, H, K, R, N, Q, F, W, Y, P, or C; L156 replaced with D, E, H, K, R, N, Q, F, W, Y, P, or C; Q157 replaced with D, E, H, K, R, A, G, I, L, S, T, M, V, F, W, Y, P, or C; Y158 replaced with D, E, H, K, R, N, Q, A, G, I, L, S, T, M, V, P, or C; L159 replaced with D, E, H K, R, N, Q, F, W, Y, P, or C; Y160 replaced with D, E, H, K, R, N, Q, A, G, I, L, S, T, M, V, P, or C; L161 replaced with D, E, H, K, R, N, Q, F, W, Y, P, or C; Q162 replaced with D, E, H, K, R, A, G, I, L, S, T, M, V, F, W, Y, P, or C; D163 replaced with H, K, R, A, G, I, L, S, T, M, V, N, Q, F, W, Y, P, or C; N164 replaced with D, E, H, K, R, A, G, I, L, S, T, M, V, F, W, Y, P, or C; A165 replaced with D, E, H, K, R, N, Q, F, W, Y, P, or C; L166 replaced with D, E, H, K, R, N, Q, F, W, Y, P, or C; Q167 replaced with D, E, H, K, R, A, G, I, L, S, T, M, V, F, W, Y, P, or C; A168 replaced with D, E, H, K, R, N, Q, F, W, Y, P, or C; L169 replaced with D, E, H, K, R, N, Q, F, W, Y, P, or C; P170 replaced with D, E, H, K, R, A, G, I, L, S, T, M, V, N, Q, F, W, Y, or C; D171 replaced with H, K, R, A, G, I, L, S, T, M, V, N, Q, F, W, Y, P, or C; D172 replaced with H, K, R, A, G, I, L, S, T, M, V, N, Q, F, W, Y, P, or C; T173 replaced with D, E, H, K, R, N, Q, F, W, Y, P, or C; F174 replaced with D, E, H, K, R, N, Q, A, G, I, L, S, T, M, V, P, or C; R175 replaced with D, E, A, G, I, L, S, T, M, V, N, Q, F, W, Y, P, or C; D176 replaced with H, K, R, A, G, I, L, S, T, M, V, N, Q, F, W, Y, P, or C; L177 replaced with D, E, H, K, R, N, Q, F, W, Y, P, or C; G178 replaced with D, E, H, K, R, N, Q, F, W, Y, P, or C; N179 replaced with D, E, H, K, R, A, G, I, L, S, T, M, V, F, W, Y, P, or C; L180 replaced with D, E, H, K, R, N, Q, F, W, Y, P, or C; T181 replaced with D, E, H, K, R, N, Q, F, W, Y, P, or C; H182 replaced with D, E, A, G, I, L, S, T, M, V, N, Q, F, W, Y, P, or C; L183 replaced with D, E, H, K, R, N, Q, F, W, Y, P, or C; F184 replaced with D, E, H, K, R, N, Q, A, G, I, L, S, T, M, V, P, or C; L185 replaced with D, E, H, K, R, N, Q, F, W, Y, P, or C; H186 replaced with D, E, A, G, I, L, S, T, M, V, N, Q, F, W, Y, P, or C; G187 replaced with D, E, H, K, R, N, Q, F, W, Y, P, or C; N188 replaced with D, E, H, K, R, A, G, I, L, S, T, M, V, F, W, Y, P, or C; R189 replaced with D, E, A, G, I, L, S, T, M, V, N, Q, F, W, Y, P, or C; I190 replaced with D, E, H, K, R, N, Q, F, W, Y, P, or C; S191 replaced with D, E, H, K, R, N, Q, F, W, Y, P, or C; S192 replaced with D, E, H, K, R, N, Q, F, W, Y, P, or C; V193 replaced with D, E, H, K, R, N, Q, F, W, Y, P, or C; P194 replaced with D, E, H, K, R, A, G, I, L, S, T, M, V, N, Q, F, W, Y, or C; E195 replaced with H, K, R, A, G, I, L, S, T, M, V, N, Q, F, W, Y, P, or C; R196 replaced with D, E, A, G, I, L, S, T, M, V, N, Q, F, W, Y, P, or C; A197 replaced with D, E, H, K, R, N, Q, F, W, Y, P, or C; F198 replaced with D, E, H, K, R, N, Q, A, G, I, L, S, T, M, V, P, or C; R199 replaced with D, E, A, G, I, L, S, T, M, V, N, Q, F, W, Y, P, or C; G200 replaced with D, E, H, K, R, N, Q, F, W, Y, P, or C; L201 replaced with D, E, H, K, R, N, Q, F, W, Y, P, or C; H202 replaced with D, E, A, G, I, L, S, T, M, V, N, Q, F, W, Y, P, or C; S203 replaced with D, E, H, K, R, N, Q, F, W, Y, P, or C; L204 replaced with D, E, H, K, R, N, Q, F, W, Y, P, or C; D205 replaced with H, K, R, A, G, I, L, S, T, M, V, N, Q, F, W, Y, P, or C; R206 replaced with D, E, A, G, I, L, S, T, M, V, N, Q, F, W, Y, P, or C; L207 replaced with D, E, H, K, R, N, Q, F, W, Y, P, or C; L208 replaced with D, E, H, K, R, N, Q, F, W, Y, P, or C; L209 replaced with D, E, H, K, R, N, Q, F, W, Y, P, or C; H210 replaced with D, E, A, G, I, L, S, T, M, V, N, Q, F, W, Y, P, or C; Q211 replaced with D, E, H, K, R, A, G, I, L, S, T, M, V, F, W, Y, P, or C; N212 replaced with D, F, H, K, R, A, G, I, L, S, T, M, V, F, W, Y, P, or C; R213 replaced with D, E, A, G, I, L, S, T, M, V, N, Q, F, W, Y, P, or C; V214 replaced with D, E, H, K, R, N, Q, F, W, Y, P, or C; A215 replaced with D, E, H, K, R, N, Q, F, W, Y, P, or C; H216 replaced with D, E, A, G, I, L, S, T, M, V, N, Q, F, W, Y, P, or C; V217 replaced with D, E, H, K, R, N, Q, F, W, Y, P, or C; H218 replaced with D, E, A, G, I, L, S, T, M, V, N, Q, F, W, Y, P, or C; P219 replaced with D, E, H, K, R, A, G, I, L, S, T, M, V, N, Q, F, W, Y, or C; H220 replaced with D, E, A, G, I, L, S, T, M, V, N, Q, F, W, Y, P, or C; A221 replaced with D, E, H, K, R, N, Q, F, W, Y, P, or C; F222 replaced with D, E, H, K, R, N, Q, A, G, I, L, S, T, M, V, P, or C; R223 replaced with D, E, A, G, I, L, S, T, M, V, N, Q, F, W, Y, P, or C; D224 replaced with H, K, R, A, G, I, L, S, T, M, V, N, Q, F, W, Y, P, or C; L225 replaced with D, E, H, K, R, N, Q, F, W, Y, P, or C; G226 replaced with D, E, H, K, R, N, Q, F, W, Y, P, or C; R227 replaced with D, E, A, G, I, L, S, T, M, V, N, Q, F, W, Y, P, or C; L228 replaced with D, E, H, K, R, N, Q, F, W, Y, P, or C; M229 replaced with D, E, H, K, R, N, Q, F, W, Y, P, or C; T230 replaced with D, E, H, K, R, N, Q, F, W, Y, P, or C; L231 replaced with D, E, H, K, R, N, Q, F, W, Y, P, or C; Y232 replaced with D, E, H, K, R, N, Q, A, G, I, L, S, T, M, V, P, or C; L233 replaced with D, E, H, K, R, N, Q, F, W, Y, P, or C; F234 replaced with D, E, H, K, R, N, Q, A, G, I, L, S, T, M, V, P, or C; A235 replaced with D, E, H, K, R, N, Q, F, W, Y, P, or C; N236 replaced with D, E, H, K, R, A, G, I, L, S, T, M, V, F, W, Y, P, or C; N237 replaced with D, E, H, K, R, A, G, I, L, S, T, M, V, F, W, Y, P, or C; L238 replaced with D, E, H, K, R, N, Q, F, W, Y, P, or C; S239 replaced with D, E, H, K, R, N, Q, F, W, Y, P, or C; A240 replaced with D, E, H, K, R, N, Q, F, W, Y, P, or C; L241 replaced with D, E, H, K, R, N, Q, F, W, Y, P, or C; P242 replaced with D, E, H, K, R, A, G, I, L, S, T, M, V, N, Q, F, W, Y, or C; T243 replaced with D, E, H, K, R, N, Q, F, W, Y, P, or C; E244 replaced with H, K, R, A, G, I, L, S, T, M, V, N, Q, F, W, Y, P, or C; A245 replaced with D, E, H, K, R, N, Q, F, W, Y, P, or C; L246 replaced with D, E, H, K, R, N, Q, F, W, Y, P, or C; A247 replaced with D, E, H, K, R, N, Q, F, W, Y, P, or C; P248 replaced with D, E, H, K, R, A, G, I, L, S, T, M, V, N, Q, F, W, Y, or C; L249 replaced with D, E, H, K, R, N, Q, F, W, Y, P, or C; R250 replaced with D, E, A, G, I, L, S, T, M, V, N, Q, F, W, Y, P, or C; A251 replaced with D, E, H, K, R, N, Q, F, W, Y, P, or C; L252 replaced with D, E, H, K, R, N, Q, F, W, Y, P, or C; Q253 replaced with D, E, H, K, R, A, G, I, L, S, T, M, V, F, W, Y, P, or C; Y254 replaced with D, E, H, K, R, N, Q, A, G, I, L, S, T, M, V, P, or C; L255 replaced with D, E, H, K, R, N, Q, F, W, Y, P, or C; R256 replaced with D, E, A, G, I, L, S, T, M, V, N, Q, F, W, Y, P, or C; L257 replaced with D, E, H, K, R, N, Q, F, W, Y, P, or C; N258 replaced with D, E, H, K, R, A, G, I, L, S, T, M, V, F, W, Y, P, or C; D259 replaced with H, K, R, A, G, I, L, S, T, M, V, N, Q, F, W, Y, P, or C; N260 replaced with D, E, H, K, R, A, G, I, L, S, T, M, V, F, W, Y, P, or C; P261 replaced with D, E, H, K, R, A, G, I, L, S, T, M, V, N, Q, F, W, Y, or C; W262 replaced with D, E, H, K, R, N, Q, A, G, I, L, S, T, M, V, P, or C; V263 replaced with D, E, H, K, R, N, Q, F, W, Y, P, or C; C264 replaced with D, E, H, K, R, A, G, I, L, S, T, M, V, N, Q, F, W, Y, or P; D265 replaced with H, K, R, A, G, I, L, S, T, M, V, N, Q, F, W, Y, P, or C; C266 replaced with D, E, H, K, R, A, G, I, L, S, T, M, V, N, Q, F, W, Y, or P; R267 replaced with D, E, A, G, I, L, S, T, M, V, N, Q, F, W, Y, P, or C; A268 replaced with D, E, H, K, R, N, Q, F, W, Y, P, or C; R269 replaced with D, E, A, G, I, L, S, T, M, V, N, Q, F, W, Y, P, or C; P270 replaced with D, E, H, K, R, A, G, I, L, S, T, M, V, N, Q, F, W, Y, or C; L271 replaced with D, E, H, K, R, N, Q, F, W, Y, P, or C; W272 replaced with D, E, H, K, R, N, Q, A, G, I, L, S, T, M, V, P, or C; A273 replaced with D, E, H, K, R, N, Q, F, W, Y, P, or C; W274 replaced with D, E, H, K, R, N, Q, A, G, I, L, S, T, M, V, P, or C; L275 replaced with D, E, H, K, R, N, Q, F, W, Y, P, or C; Q276 replaced with D, E, H, K, R, A, G, I, L, S, T, M, V, F, W, Y, P, or C; K277 replaced with D, E, A, G, I, L, S, T, M, V, N, Q, F, W, Y, P, or C; F278 replaced with D, E, H, K, R, N, Q, A, G, I, L, S, T, M, V, P, or C; R279 replaced with D, E, A, G, I, L, S, T, M, V, N, Q, F, W, Y, P, or C; G280 replaced with D, E, H, K, R, N, Q, F, W, Y, P, or C; S281 replaced with D, E, H, K, R, N, Q, F, W, Y, P, or C; S282 replaced with D, E, H, K, R, N, Q, F, W, Y, P, or C; S283 replaced with D, E, H, K, R, N, Q, F, W, Y, P, or C; E284 replaced with H, K, R, A, G, I, L, S, T, M, V, N, Q, F, W, Y, P, or C; V285 replaced with D, E, H, K, R, N, Q, F, W, Y, P, or C; P286 replaced with D, E, H, K, R, A, G, I, L, S, T, M, V, N, Q, F, W, Y, or C; C287 replaced with D, E, H, K, R, A, G, I, L, S, T, M, V, N, Q, F, W, Y, or P; S288 replaced with D, E, H, K, R, N, Q, F, W, Y, P, or C; L289 replaced with D, E, H, K, R, N, Q, F, W, Y, P, or C; P290 replaced with D, E, H, K, R, A, G, I, L, S, T, M, V, N, Q, F, W, Y, or C; Q291 replaced with D, E, H, K, R, A, G, L, S, T, M, V, F, W, Y, P, or C; R292 replaced with D, E, A, G, I, L, S, T, M, V, N, Q, F, W, Y, P, or C; L293 replaced with D, E, H, K, R, N, Q, F, W, Y, P, or C; A294 replaced with D, E, H, K, R, N, Q, F, W, Y, P, or C; G295 replaced with D, E, H, K, R, N, Q, F, W, Y, P, or C; R296 replaced with D, E, A, G, I, L, S, T, M, V, N, Q, F, W, Y, P, or C; D297 replaced with H, K, R, A, G, I, L, S, T, M, V, N, Q, F, W, Y, P, or C; L298 replaced with D, E, H, K, R, N, Q, F, W, Y, P, or C; K299 replaced with D, E, A, G, I, L, S, T, M, V, N, Q, F, W, Y, P, or C; R300 replaced with D, E, A, G, I, L, S, T, M, V, N, Q, F, W, Y, P, or C; L301 replaced with D, E, H, K, R, N, Q, F, W, Y, P, or C; A302 replaced with D, E, H K, R, N, Q, F, W, Y, P, or C; A303 replaced with D, E, H, K, R, N, Q, F, W, Y, P, or C; N304 replaced with D, E, H, K, R, A, G, I, L, S, T, M, V, F, W, Y, P, or C; D305 replaced with H, K, R, A, G, I, L, S, T, M, V, N, Q, F, W, Y, P, or C; L306 replaced with D, E, H, K, R, N, Q, F, W, Y, P, or C; Q307 replaced with D, E, H, K, R, A, G, I, L, S, T, M, V, F, W, Y, P, or C; G308 replaced with D, E, H, K, R, N, Q, F, W, Y, P, or C; C309 replaced with D, E, H, K, R, A, G, I, L, S, T, M, V, N, Q, F, W, Y, or P; A310 replaced with D, E, H, K, R, N, Q, F, W, Y, P, or C; V311 replaced with D, E, H, K, R, N, Q, F, W, Y, P, or C; A312 replaced with D, E, H, K, R, N, Q, F, W, Y, P, or C; T313 replaced with D, E, H, K, R, N, Q, F, W, Y, P, or C; G314 replaced with D, E, H, K, R, N, Q, F, W, Y, P, or C; P315 replaced with D, E, H, K, R, A, G, I, L, S, T, M, V, N, Q, F, W, Y, or C; Y316 replaced with D, E, H, K, R, N, Q, A, G, I, L, S, T, M, V, P, or C; H317 replaced with D, E, A, G, I, L, S, T, M, V, N, Q, F, W, Y, P, or C; P318 replaced with D, E, H, K, R, A, G, I, L, S, T, M, V, N, Q, F, W, Y, or C; 1319 replaced with D, E, H, K, R, N, Q, F, W, Y, P, or C; W320 replaced with D, E, H, K, R, N, Q, A, G, I, L, S, T, M, V, P, or C; T321 replaced with D, E, H, K, R, N, Q, F, W, Y, P, or C; G322 replaced with D, E, H, K, R, N, Q, F, W, Y, P, or C; R323 replaced with D, E, A, G, I, L, S, T, M, V, N, Q, F, W, Y, P, or C; A324 replaced with D, E, H, K, R, N, Q, F, W, Y, P, or C; T325 replaced with D, E, H, K, R, N, Q, F, W, Y, P, or C; D326 replaced with H, K, R, A, G, I, L, S, T, M, V, N, Q, F, W, Y, P, or C; E327 replaced with H, K, R, A, G, I, L, S, T, M, V, N, Q, F, W, Y, P, or C; E328 replaced with H, K, R, A, G, I, L, S, T, M, V, N, Q, F, W, Y, P, or C; P329 replaced with D, E, H, K, R, A, G, I, L, S, T, M, V, N, Q, F, W, Y, or C; L330 replaced with D, E, H, K, R, N, Q, F, W, Y, P, or C; G331 replaced with D, E, H, K, R, N, Q, F, W, Y, P, or C; L332 replaced with D, E, H, K, R, N, Q, F, W, Y, P, or C; P333 replaced with D, E, H, K, R, A, G, I, L, S, T, M, V, N, Q, F, W, Y, or C; K334 replaced with D, E, A, G, I, L, S, T, M, V, N, Q, F, W, Y, P, or C; C335 replaced with D, E, H, K, R, A, G, I, L, S, T, M, V, N, Q, F, W, Y, or P; C336 replaced with D, E, H, K, R, A, G, I, L, S, T, M, V, N, Q, F, W, Y, or P; Q337 replaced with D, E, H, K, R, A, G, I, L, S, T, M, V, F, W, Y, P, or C; P338 replaced with D, E, H, K, R, A, G, I, L, S, T, M, V, N, Q, F, W, Y, or C; D339 replaced with H, K, R, A, G, I, L, S, T, M, V, N, Q, F, W, Y, P, or C; A340 replaced with D, E, H, K, R, N, Q, F, W, Y, P, or C; A341 replaced with D, E, H, K, R, N, Q, F, W, Y, P, or C; D342 replaced with H, K, R, A, G, I, L, S, T, M, V, N, Q, F, W, Y, P, or C; K343 replaced with D, E, A, G, I, L, S, T, M, V, N, Q, F, W, Y, P, or C; A344 replaced with D, E, H, K, R, N, Q, F, W, Y, P, or C; S345 replaced with D, E, H, K, R, N, Q, F, W, Y, P, or C; V346 replaced with D, E, H, K, R, N, Q, F, W, Y, P, or C; L347 replaced with D, E, H, K, R, N, Q, F, W, Y, P, or C; E348 replaced with H, K, R, A, G, I, L, S, T, M, V, N, Q, F, W, Y, P, or C; P349 replaced with D, E, H, K, R, A, G, I, L, S, T, M, V, N, Q, F, W, Y, or C; G350 replaced with D, E, H, K, R, N, Q, F, W, Y, P, or C; R351 replaced with D, E, A, G, I, L, S, T, M, V, N, Q, F, W, Y, P, or C; P352 replaced with D, E, H, K, R, A, G, I, L, S, T, M, V, N, Q, F, W, Y, or C; A353 replaced with D, E, H, K, R, N, Q, F, W, Y, P, or C; S354 replaced with D, E, H, K, R, N, Q, F, W, Y, P, or C; A355 replaced with D, E, H, K, R, N, Q, F, W, Y, P, or C; G356 replaced with D, E, H, K, R, N, Q, F, W, Y, P, or C; N357 replaced with D, E, H, K, R, A, G, I, L, S, T, M, V, F, W, Y, P, or C; A358 replaced with D, E, H, K, R, N, Q, F, W, Y, P, or C; L359 replaced with D, E, H, K, R, N, Q, F, W, Y, P, or C; K360 replaced with D, E, A, G, I, L, S, T, M, V, N, Q, F, W, Y, P, or C; G361 replaced with D, E, H, K, R, N, Q, F, W, Y, P, or C; R362 replaced with D, E, A, G, I, L, S, T, M, V, N, Q, F, W, Y, P, or C; V363 replaced with D, E, H, K, R, N, Q, F, W, Y, P, or C; P364 replaced with D, E, H, K, R, A, G, I, L, S, T, M, V, N, Q, F, W, Y, or C; P365 replaced with D, E, H, K, R, A, G, I, L, S, T, M, V, N, Q, F, W, Y, or C; G366 replaced with D, E, H, K, R, N, Q, F, W, Y, P, or C; D367 replaced with H, K, R, A, G, I, L, S, T, M, V, N, Q, F, W, Y, P, or C; S368 replaced with D, E, H, K, R, N, Q, F, W, Y, P, or C; P369 replaced with D, E, H, K, R, A, G, I, L, S, T, M, V, N, Q, F, W, Y, or C; P370 replaced with D, E, H, K, R, A, G, I, L, S, T, M, V, N, Q, F, W, Y, or C; G371 replaced with D, E, H, K, R, N, Q, F, W, Y, P, or C; N372 replaced with D, E, H, K, R, A, G, I, L, S, T, M, V, F, W, Y, P, or C; G373 replaced with D, E, H, K, R, N, Q, F, W, Y, P, or C; S374 replaced with D, E, H, K, R, N, Q, F, W, Y, P, or C; G375 replaced with D, E, H, K, R, N, Q, F, W, Y, P, or C; P376 replaced with D, E, H, K, R, A, G, I, L, S, T, M, V, N, Q, F, W, Y, or C; R377 replaced with D, E, A, G, I, L, S, T, M, V, N, Q, F, W, Y, P, or C; H378 replaced with D, E, A, G, I, L, S, T, M, V, N, Q, F, W, Y, P, or C; I379 replaced with D, E, H, K, R, N, Q, F, W, Y, P, or C; N380 replaced with D, E, H, K, R, A, G, I, L, S, T, M, V, F, W, Y, P, or C; D381 replaced with H, K, R, A, G, I, L, S, T, M, V, N, Q, F, W, Y, P, or C; S382 replaced with D, E, H, K, R, N, Q, F, W, Y, P, or C; P383 replaced with D, E, H, K, R, A, G, I, L, S, T, M, V, N, Q, F, W, Y, or C; F384 replaced with D, E, H, K, R, N, Q, A, G, I, L, S, T, M, V, P, or C; G385 replaced with D, E, H, K, R, N, Q, F, W, Y, P, or C; T386 replaced with D, E, H, K, R, N, Q, F, W, Y, P, or C; L387 replaced with D, E, H, K, R, N, Q, F, W, Y, P, or C; P388 replaced with D, E, H, K, R, A, G, I, L, S, T, M, V, N, Q, F, W, Y, or C; G389 replaced with D, E, H, K, R, N, Q, F, W, Y, P, or C; S390 replaced with D, E, H, K, R, N, Q, F, W, Y, P, or C; A391 replaced with D, E, H, K, R, N, Q, F, W, Y, P, or C; E392 replaced with H, K, R, A, G, I, L, S, T, M, V, N, Q, F, W, Y, P, or C; P393 replaced with D, E, H, K, R, A, G, I, L, S, T, M, V, N, Q, F, W, Y, or C; P394 replaced with D, E, H, K, R, A, G, I, L, S, T, M, V, N, Q, F, W, Y, or C; A395 replaced with D, E, H, K, R, N, Q, F, W, Y, P, or C; H396 replaced with D, E, A, G, I, L, S, T, M, V, N, Q, F, W, Y, P, or C; C397 replaced with D, E, H, K, R, A, G, I, L, S, T, M, V, N, Q, F, W, Y, or P; S398 replaced with D, E, H, K, R, N, Q, F, W, Y, P, or C; A399 replaced with D, E, H, K, R, N, Q, F, W, Y, P, or C; A400 replaced with D, E, H, K, R, N, Q, F, W, Y, P, or C; R401 replaced with D, E, A, G, I, L, S, T, M, V, N, Q, F, W, Y, P, or C; G402 replaced with D, E, H, K, R, N, Q, F, W, Y, P, or C; L403 replaced with D, E, H, K, R, N, Q, F, W, Y, P, or C; R404 replaced with D, E, A, G, I, L, S, T, M, V, N, Q, F, W, Y, P, or C; A405 replaced with D, E, H, K, R, N, Q, F, W, Y, P, or C; T406 replaced with D, E, H, K, R, N, Q, F, W, Y, P, or C; R407 replaced with D, E, A, G, I, L, S, T, M, V, N, Q, F, W, Y, P, or C; F408 replaced with D, E, H, K, R, N, Q, A, G, I, L, S, T, M, V, P, or C; P409 replaced with D, E, H, K, R, A, G, I, L, S, T, M, V, N, Q, F, W, Y, or C; T410 replaced with D, E, H, K, R, N, Q, F, W, Y, P, or C; S411 replaced with D, E, H, K, R, N, Q, F, W, Y, P, or C; G412 replaced with D, E, H, K, R, N, Q, F, W, Y, P, or C; P413 replaced with D, E, H, K, R, A, G, I, L, S, T, M, V, N, Q, F, W, Y, or C; R414 replaced with D, E, A, G, I, L, S, T, M, V, N, Q, F, W, Y, P, or C; R415 replaced with D, E, A, G, I, L, S, T, M, V, N, Q, F, W, Y, P, or C; R416 replaced with D, E, A, G, I, L, S, T, M, V, N, Q, F, W, Y, P, or C; P417 replaced with D, E, H, K, R, A, G, I, L, S, T, M, V, N, Q, F, W, Y, or C; G418 replaced with D, E, H, K, R, N, Q, F, W, Y, P, or C; C419 replaced with D, E, H, K, R, A, G, I, L, S, T, M, V, N, Q, F, W, Y, or P; S420 replaced with D, E, H, K, R, N, Q, F, W, Y, P, or C; R421 replaced with D, E, A, G, I, L, S, T, M, V, N, Q, F, W, Y, P, or C; K422 replaced with D, E, A, G, I, L, S, T, M, V, N, Q, F, W, Y, P, or C; N423 replaced with D, E, H, K, R, A, G, I, L, S, T, M, V, F, W, Y, P, or C; R424 replaced with D, E, A, G, I, L, S, T, M, V, N, Q, F, W, Y, P, or C; T425 replaced with D, E, H, K, R, N, Q, F, W, Y, P, or C; R426 replaced with D, E, A, G, I, L, S, T, M, V, N, Q, F, W, Y, P, or C; S427 replaced with D, E, H, K, R, N, Q, F, W, Y, P, or C; H428 replaced with D, E, A, G, I, L, S, T, M, V, N, Q, F, W, Y, P, or C; C429 replaced with D, E, H, K, R, A, G, I, L, S, T, M, V, N, Q, F, W, Y, or P; R430 replaced with D, E, A, G, I, L, S, T, M, V, N, Q, F, W, Y, P, or C; L431 replaced with D, E, H, K, R, N, Q, F, W, Y, P, or C; G432 replaced with D, E, H, K, R, N, Q, F, W, Y, P, or C; Q433 replaced with D, E, H, K, R, A, G, I, L, S, T, M, V, F, W, Y, P, or C; A434 replaced with D, E, H, K, R, N, Q, F, W, Y, P, or C; G435 replaced with D, E, H, K, R, N, Q, F, W, Y, P, or C; S436 replaced with D, E, H, K, R, N, Q, F, W, Y, P, or C; G437 replaced with D, E, H, K, R, N, Q, F, W, Y, P, or C; G438 replaced with D, E, H, K, R, N, Q, F, W, Y, P, or C; G439 replaced with D, E, H, K, R, N, Q, F, W, Y, P, or C; G440 replaced with D, E, H, K, R, N, Q, F, W, Y, P, or C; T441 replaced with D, E, H, K, R, N, Q, F, W, Y, P, or C; G442 replaced with D, E, H, K, R, N, Q, F, W, Y, P, or C; D443 replaced with H, K, R, A, G, I, L, S, T, M, V, N, Q, F, W, Y, P, or C; S444 replaced with D, E, H, K, R, N, Q, F, W, Y, P, or C; E445 replaced with H, K, R, A, G, I, L, S, T, M, V, N, Q, F, W, Y, P, or C; G446 replaced with D, E, H, K, R, N, Q, F, W, Y, P, or C; S447 replaced with D, E, H, K, R, N, Q, F, W, Y, P, or C; G448 replaced with D, E, H, K, R, N, Q, F, W, Y, P, or C; A449 replaced with D, E, H, K, R, N, Q, F, W, Y, P, or C; L450 replaced with D, E, H, K, R, N, Q, F, W, Y, P, or C; P451 replaced with D, E, H, K, R, A, G, I, L, S, T, M, V, N, Q, F, W, Y, or C; S452 replaced with D, E, H, K, R, N, Q, F, W, Y, P, or C; L453 replaced with D, E, H, K, R, N, Q, F, W, Y, P, or C; T454 replaced with D, E, H, K, R, N, Q, F, W, Y, P, or C; C455 replaced with D, E, H, K, R, A, G, I, L, S, T, M, V, N, Q, F, W, Y, or P; S456 replaced with D, E, H, K, R, N, Q, F, W, Y, P, or C; L457 replaced with D, E, H, K, R, N, Q, F, W, Y, P, or C; T458 replaced with D, E, H, K, R, N, Q, F, W, Y, P, or C; P459 replaced with D, E, H, K, R, A, G, I, L, S, T, M, V, N, Q, F, W, Y, or C; L460 replaced with D, E, H, K, R, N, Q, F, W, Y, P, or C; G461 replaced with D, E, H, K, R, N, Q, F, W, Y, P, or C; L462 replaced with D, E, H, K, R, N, Q, F, W, Y, P, or C; A463 replaced with D, E, H, K, R, N, Q, F, W, Y, P, or C; L464 replaced with D, E, H, K, R, N, Q, F, W, Y, P, or C; V465 replaced with D, E, H, K, R, N, Q, F, W, Y, P, or C; L466 replaced with D, E, H, K, R, N, Q, F, W, Y, P, or C; W467 replaced with D, E, H, K, R, N, Q, A, G, I, L, S, T, M, V, P, or C; T468 replaced with D, E, H, K, R, N, Q, F, W, Y, P, or C; V469 replaced with D, E, H, K, R, N, Q, F, W, Y, P, or C; L470 replaced with D, E, H, K, R, N, Q, F, W, Y, P, or C; G471 replaced with D, E, H, K, R, N, Q, F, W, Y, P, or C; P472 replaced with D, E, H, K, R, A, G, I, L, S, T, M, V, N, Q, F, W, Y, or C; C473 replaced with D, E, H, K, R, A, G, I, L, S, T, M, V, N, Q, F, W, Y, or P; of SEQ ID NO:2.

Amino acids in the NogoR protein of the present invention that are essential for function can be identified by methods known in the art, such as site-directed mutagenesis or alanine-scanning mutagenesis (Cunningham and Wells, *Science* 244: 1081-1085 (1989)). The latter procedure introduces single alanine mutations at every residue in the molecule. The resulting mutant molecules are then tested for biological activity such as receptor binding or protein multimerization, pore formation, and toxin translocation. Sites that are critical for ligand-receptor binding can also be determined by structural analysis such as crystallization, nuclear magnetic resonance or photoaffinity labeling (Smith et al., *J Mol Biol* 224:899-904 (1992) and de Vos et al., *Science* 255:306-312 (1992)). In preferred embodiments, antibodies of the present invention bind regions of NogoR that are essential for NogoR function. In other preferred embodiments, antibodies of the present invention bind regions of NogoR that are essential for NogoR function such as, for example, the LRR domains in NogoR. In specific embodiments, antibodies of the present invention bind regions of NogoR that are essential for NogoR function and inhibit or abolish NogoR function.

Additionally, protein engineering may be employed to improve or alter the characteristics of the NogoR polypeptides. Recombinant DNA technology known to those skilled in the art can be used to create novel mutant proteins or muteins including single or multiple amino acid substitutions, deletions, additions or fusion proteins. Such modified polypeptides can show, e.g., enhanced activity or increased stability. In addition, they may be purified in higher yields and show better solubility than the corresponding natural polypeptide, at least under certain purification and storage conditions. Antibodies of the present invention may bind such modified NogoR polypeptides.

Non-naturally occurring variants of NogoR may be produced using art-known mutagenesis techniques, which include, but are not limited to oligonucleotide mediated mutagenesis, alanine scanning, PCR mutagenesis, site directed mutagenesis (see e.g., Carter et al, *Nucl Acids Res* 13:4331 (1986); Zoller et al., *Nucl. Acids Res* 10:6487 (1982)), cassette mutagenesis (see e.g., Wells et al., *Gene* 34:315 (1985)), restriction selection mutagenesis (see e.g., Wells et al., *Philos Trans R Soc London Ser A* 317:415 (1986)).

Thus, the invention also encompasses antibodies that bind NogoR derivatives and analogs that have one or more amino acid residues deleted, added, or substituted to generate NogoR polypeptides that are better suited for expression, scale up, etc., in the host cells chosen. For example, cysteine residues can be deleted or substituted with another amino acid residue in order to eliminate disulfide bridges; N-linked glycosylation sites can be altered or eliminated to achieve, for example, expression of a homogeneous product that is more easily recovered and purified from yeast hosts which are known to hyperglycosylate N-linked sites. To this end, a variety of amino acid substitutions at one or both of the first or third amino acid positions on any one or more of the glycosylation recognition sequences in the NogoR polypeptides and/or an amino acid deletion at the second position of any one or more such recognition sequences will prevent glycosylation of NogoR at the modified tripeptide sequence (see, e.g., Miyajima et al., *EMBO J.* 5(6):1193-1197). Additionally, one or more of the amino acid residues of NogoR polypeptides (e.g., arginine and lysine residues) may be deleted or substituted with another residue to eliminate undesired processing by proteases such as, for example, furins or kexins.

The antibodies of the present invention also include antibodies that bind a polypeptide comprising, or alternatively, consisting of a polypeptide comprising, or alternatively, consisting of the polypeptide of SEQ ID NO:2 including the leader; a polypeptide comprising, or alternatively, consisting of the polypeptide of SEQ ID NO:2 minus the amino terminal methionine; a polypeptide comprising, or alternatively, consisting of the polypeptide of SEQ ID NO:2 minus the leader; as well as polypeptides which are at least 80% identical, more preferably at least 90% or 95% identical, still more preferably at least 96%, 97%, 98% or 99% identical to the polypeptides described above (the polypeptide and polypeptide fragments of SEQ ID NO:2), and portions of such polypeptides with at least 30 amino acids and more preferably at least 50 amino acids.

By a polypeptide having an amino acid sequence at least, for example, 95% "identical" to a reference amino acid sequence of a NogoR polypeptide is intended that the amino acid sequence of the polypeptide is identical to the reference sequence except that the polypeptide sequence may include up to five amino acid alterations per each 100 amino acids of the reference amino acid of the NogoR polypeptide. In other words, to obtain a polypeptide having an amino acid sequence at least 95% identical to a reference amino acid sequence, up to 5% of the amino acid residues in the reference sequence may be deleted or substituted with another amino acid, or a number of amino acids up to 5% of the total amino acid residues in the reference sequence may be inserted into the reference sequence. These alterations of the reference sequence may occur at the amino or carboxy terminal positions of the reference amino acid sequence or anywhere between those terminal positions, interspersed either individually among residues in the reference sequence or in one or more contiguous groups within the reference sequence.

As a practical matter, whether any particular polypeptide is at least 90%, 95%, 96%, 97%, 98% or 99% identical to, for instance, the amino acid sequence shown in SEQ ID NO:2 can be determined conventionally using known computer programs such the Bestfit program (Wisconsin Sequence Analysis Package, Version 8 for Unix, Genetics Computer Group, University Research Park, 575 Science Drive, Madison, Wis. 53711). When using Bestfit or any other sequence alignment program to determine whether a particular sequence is, for instance, 95% identical to a reference sequence according to the present invention, the parameters are set, of course, such that the percentage of identity is calculated over the full length of the reference amino acid sequence and that gaps in homology of up to 5% of the total number of amino acid residues in the reference sequence are allowed.

In a specific embodiment, the identity between a reference (query) sequence (a sequence of the present invention) and a subject sequence, also referred to as a global sequence alignment, is determined using the FASTDB computer program based on the algorithm of Brutlag et al. *Comp App Biosci* 6:237-245 (1990). Preferred parameters used in a FASTDB amino acid alignment are: Matrix=PAM 0, k-tuple=2, Mismatch Penalty=1, Joining Penalty=20, Randomization Group Length=0, Cutoff Score=1, Window Size=sequence length, Gap Penalty=5, Gap Size Penalty=0.05, Window Size=500 or the length of the subject amino acid sequence, whichever is shorter. According to this embodiment, if the subject sequence is shorter than the query sequence due to N- or C-terminal deletions, not because of internal deletions, a manual correction is made to the results to take into consideration the fact that the FASTDB program does not account for N- and C-terminal truncations of the subject sequence when calculating global percent identity. For subject sequences truncated at the N- and C-termini, relative to the query sequence, the percent identity is corrected by calculating the number of residues of the query sequence that are N- and C-terminal of the subject sequence, which are not matched/aligned with a corresponding subject residue, as a percent of the total bases of the query sequence. A determination of whether a residue is matched/aligned is determined by results of the FASTDB sequence alignment. This percentage is then subtracted from the percent identity, calculated by the above FASTDB program using the specified parameters, to arrive at a final percent identity score. This final percent identity score is what is used for the purposes of this embodiment. Only residues to the N- and C-termini of the subject sequence, which are not matched/aligned with the query sequence, are considered for the purposes of manually adjusting the percent identity score. That is, only query residue positions outside the farthest N- and C-terminal residues of the subject sequence. For example, a 90 amino acid residue subject sequence is aligned with a 100 residue query sequence to determine percent identity. The deletion occurs at the N-terminus of the subject sequence and therefore, the FASTDB alignment does not show a matching/alignment of the first 10 residues at the N-terminus. The 10 unpaired residues represent 10% of the sequence (number of residues at the N- and C-termini not matched/total number of residues in the query sequence) so 10% is subtracted from the percent identity score calculated by the FASTDB program. If the remaining 90 residues were perfectly matched the final percent identity would be 90%. In another example, a 90 residue subject sequence is compared with a 100 residue query sequence. This time the deletions are internal deletions so there are no residues at the N- or C-termini of the subject sequence which are not matched/aligned with the query. In this case the percent identity calculated by FASTDB is not manually corrected. Once again, only residue positions outside the N- and C-terminal ends of the subject sequence, as displayed in the FASTDB alignment, which are not matched/aligned with the query sequence are manually corrected for. No other manual corrections are made for the purposes of this embodiment.

The present application is also directed to antibodies that bind proteins containing polypeptides at least 90%, 95%, 96%, 97%, 98% or 99% identical to the NogoR polypeptide sequence set forth herein as $n^1$-$m^1$. In preferred embodiments, the application is directed to antibodies that bind proteins containing polypeptides at least 90%, 95%, 96%, 97%, 98% or 99% identical to polypeptides having the amino acid sequence of the specific NogoR N- and C-terminal deletions recited herein.

In certain preferred embodiments, antibodies of the invention bind NogoR fusion proteins as described above wherein the NogoR portion of the fusion protein are those described as $n^1$-$m^1$ herein.

Antibodies of the Invention May Bind Modified NogoR Polypeptides

It is specifically contemplated that antibodies of the present invention may bind modified forms of the NogoR protein (SEQ ID NO:2). In specific embodiments, antibodies of the present invention bind NogoR polypeptides (such as those described above) including, but not limited to naturally purified NogoR polypeptides, NogoR polypeptides produced by chemical synthetic procedures, and NogoR polypeptides produced by recombinant techniques from a prokaryotic or eukaryotic host, including, for example, bacterial, yeast, higher plant, insect and mammalian cells using, for example, the recombinant compositions and methods described above. Depending upon the host employed in a recombinant production procedure, the polypeptides may be glycosylated or nonglycosylated. In addition, NogoR polypeptides may also include an initial modified methionine residue, in some cases as a result of host-mediated processes.

In addition, antibodies of the present invention may bind NogoR proteins that were chemically synthesized using techniques known in the art (e.g., see Creighton, Proteins: Structures and Molecular Principles, W.H. Freeman & Co., N.Y. (1983), and Hunkapiller et al., *Nature* 310:105-111 (1984)). For example, a peptide corresponding to a fragment of a NogoR polypeptide can be synthesized by use of a peptide synthesizer. Furthermore, if desired, nonclassical amino acids or chemical amino acid analogs can be introduced as a substitution or addition into the NogoR polypeptide sequence. Non-classical amino acids include, but are not limited to, to the D-isomers of the common amino acids, 2,4-diaminobutyric acid, a-amino isobutyric acid, 4-aminobutyric acid, Abu, 2-amino butyric acid, g-Abu, e-Ahx, 6-amino hexanoic acid, Aib, 2-amino isobutyric acid, 3-amino propionic acid, ornithine, norleucine, norvaline, hydroxyproline, sarcosine, citrulline, homocitrulline, cysteic acid, t-butylglycine, t-butylalanine, phenylglycine, cyclohexylalanine, b-alanine, fluoro-amino acids, designer amino acids such as b-methyl amino acids, Ca-methyl amino acids, Na-methyl amino acids, and amino acid analogs in general. Furthermore, the amino acid can be D (dextrorotary) or L (levorotary).

The invention additionally encompasses antibodies that bind the NogoR polypeptide that are differentially modified during or after translation, e.g., by glycosylation, acetylation, phosphorylation, amidation, derivatization by known protecting/blocking groups, proteolytic cleavage, linkage to an antibody molecule or other cellular ligand, etc. Any of numerous chemical modifications may be carried out by known techniques, including but not limited to, specific chemical cleavage by cyanogen bromide, trypsin, chymotrypsin, papain, V8 protease, $NaBH_4$, acetylation, formylation, oxidation, reduction, metabolic synthesis in the presence of tunicamycin, etc.

Additional post-translational modifications to the NogoR polypeptide for example, N-linked or O-linked carbohydrate chains, processing of N-terminal or C-terminal ends, attachment of chemical moieties to the amino acid backbone, chemical modifications of N-linked or O-linked carbohydrate chains, and addition or deletion of an N-terminal methionine residue as a result of prokaryotic host cell expression. The polypeptides may also be modified with a detectable label, such as an enzymatic, fluorescent, isotopic or affinity label to allow for detection and isolation of the protein.

Also provided by the invention are antibodies that bind chemically modified derivatives of the NogoR polypeptide which may provide additional advantages such as increased solubility, stability and circulating time of the polypeptide, or decreased immunogenicity (see U.S. Pat. No. 4,179,337). The chemical moieties for derivitization may be selected from water soluble polymers such as polyethylene glycol, ethylene glycol/propylene glycol copolymers, carboxymethylcellulose, dextran, polyvinyl alcohol and the like. The polypeptides may be modified at random positions within the molecule, or at predetermined positions within the molecule and may include one, two, three or more attached chemical moieties.

The polymer may be of any molecular weight, and may be branched or unbranched. For polyethylene glycol, the preferred molecular weight is between about 1 kilodalton and about 100 kilodalton (the term "about" indicating that in preparations of polyethylene glycol, some molecules will weigh more, some less, than the stated molecular weight) for ease in handling and manufacturing. Other sizes may be used, depending on the desired therapeutic profile (e.g., the duration of sustained release desired, the effects, if any on biological activity, the ease in handling, the degree or lack of antigenicity and other known effects of the polyethylene glycol to a therapeutic protein or analog). For example, polyethylene glycol may have an average molecular weight of about 200, 500, 1000, 1500, 2000, 2500, 3000, 3500, 4000, 4500, 5000, 5500, 6000, 6500, 7000, 7500, 8000, 8500, 9000, 9500, 10,000, 10,500, 11,000, 11,500, 12,000, 12,500, 13,000, 13,500, 14,000, 14,500, 15,000, 15,500, 16,000, 16,500, 17,000, 17,500, 18,000, 18,500, 19,000, 19,500, 20,000, 25,000, 30,000, 35,000, 40,000, 50,000, 55,000, 60,000, 65,000, 70,000, 75,000, 80,000, 85,000, 90,000, 95,000, or 100,000 kilodalton.

As noted above, polyethylene glycol may have a branched structure. Branched polyethylene glycols are described, for example, in U.S. Pat. No. 5,643,575; Morpurgo et al., *Appl Biochem Biotechnol* 56:59-72 (1996); Vorobjev et al., *Nucleosides Nucleotides* 18:2745-2750 (1999); and Caliceti et al., *Bioconjug Chem* 10:638-646 (1999), the disclosures of each of which are incorporated herein by reference.

The polyethylene glycol molecules (or other chemical moieties) should be attached to the protein with consideration of effects on functional or antigenic domains of the protein. There are a number of attachment methods available to those skilled in the art, e.g., EP 0 401 384, herein incorporated by reference (coupling PEG to G-CSF), see also Malik et al., *Exp Hematol* 20:1028-1035 (1992) (reporting pegylation of GM- CSF using tresyl chloride). For example, polyethylene glycol may be covalently bound through amino acid residues via a reactive group, such as, a free amino or carboxyl group. Reactive groups are those to which an activated polyethylene glycol molecule may be bound. The amino acid residues having a free amino group may include lysine residues and the N-terminal amino acid residues; those having a free carboxyl group may include aspartic acid residues, glutamic acid residues and the C-terminal amino acid residue. Sulfhydryl groups may also be used as a reactive group for attaching the polyethylene glycol molecules. Preferred for therapeutic purposes is attachment at an amino group, such as attachment at the N-terminus or lysine group.

As suggested above, polyethylene glycol may be attached to proteins via linkage to any of a number of amino acid residues. For example, polyethylene glycol can be linked to a proteins via covalent bonds to lysine, histidine, aspartic acid, glutamic acid, or cysteine residues. One or more reaction chemistries may be employed to attach polyethylene glycol to specific amino acid residues (e.g., lysine, histidine, aspartic acid, glutamic acid, or cysteine) of the protein or to more than one type of amino acid residue (e.g., lysine, histidine, aspartic acid, glutamic acid, cysteine and combinations thereof) of the protein.

One may specifically desire proteins chemically modified at the N-terminus. Using polyethylene glycol as an illustration of the present composition, one may select from a variety of polyethylene glycol molecules (by molecular weight, branching, etc.), the proportion of polyethylene glycol molecules to protein (or peptide) molecules in the reaction mix, the type of pegylation reaction to be performed, and the method of obtaining the selected N-terminally pegylated protein. The method of obtaining the N-terminally pegylated preparation (i.e., separating this moiety from other monopegylated moieties if necessary) may be by purification of the N-terminally pegylated material from a population of pegylated protein molecules. Selective proteins chemically modified at the N-terminus modification may be accomplished by reductive alkylation which exploits differential reactivity of different types of primary amino groups (lysine versus the N-terminal) available for derivatization in a particular protein. Under the appropriate reaction conditions, substantially selective derivatization of the protein at the N-terminus with a carbonyl group containing polymer is achieved.

As indicated above, pegylation of the proteins of the invention may be accomplished by any number of means. For example, polyethylene glycol may be attached to the protein either directly or by an intervening linker. Linkerless systems for attaching polyethylene glycol to proteins are described in Delgado et al., *Crit Rev Ther Drug Carrier Syst* 9:249-304 (1992); Francis et al., *Intern J Hematol* 68:1-18 (1998); U.S. Pat. No. 4,002,531; U.S. Pat. No. 5,349,052; WO 95/06058; and WO 98/32466, the disclosures of each of which are incorporated herein by reference.

One system for attaching polyethylene glycol directly to amino acid residues of proteins without an intervening linker employs tresylated MPEG, which is produced by the modification of monmethoxy polyethylene glycol (MPEG) using tresylchloride ($ClSO_2CH_2CF_3$). Upon reaction of protein with tresylated MPEG, polyethylene glycol is directly attached to amine groups of the protein. Thus, the invention includes protein-polyethylene glycol conjugates produced by reacting proteins of the invention with a polyethylene glycol molecule having a 2,2,2-trifluoreothane sulphonyl group.

Polyethylene glycol can also be attached to proteins using a number of different intervening linkers. For example, U.S. Pat. No. 5,612,460, the entire disclosure of which is incorporated herein by reference, discloses urethane linkers for connecting polyethylene glycol to proteins. Protein-polyethylene glycol conjugates wherein the polyethylene glycol is attached to the protein by a linker can also be produced by reaction of proteins with compounds such as MPEG-succinimidylsuccinate, MPEG activated with 1,1'-carbonyldiimidazole, MPEG-2,4,5-trichloropenylcarbonate, MPEG-p-nitrophenolcarbonate, and various MPEG-succinate derivatives. A number additional polyethylene glycol derivatives and reaction chemistries for attaching polyethylene glycol to proteins are described in WO 98/32466, the entire disclosure of which is incorporated herein by reference. Pegylated protein products produced using the reaction chemistries set out herein are included within the scope of the invention.

The number of polyethylene glycol moieties attached to the NogoR polypeptide (i.e., the degree of substitution) may also vary. For example, the pegylated proteins of the invention may be linked, on average, to 1, 2, 3, 4, 5, 6, 7, 8, 9, 10, 12, 15, 17, 20, or more polyethylene glycol molecules. Similarly, the average degree of substitution within ranges such as 1-3, 24, 3-5, 4-6, 5-7, 6-8, 7-9, 8-10, 9-11, 10-12, 11-13, 12-14, 13-15, 14-16, 15-17, 16-18, 17-19, or 18-20 polyethylene glycol moieties per protein molecule. Methods for determining the degree of substitution are discussed, for example, in Delgado et al., *Crit Rev Ther Drug Carrier Syst* 9:249-304 (1992).

As mentioned the antibodies of the present invention may bind NogoR polypeptides that are modified by either natural processes, such as posttranslational processing, or by chemical modification techniques which are well known in the art. It will be appreciated that the same type of modification may be present in the same or varying degrees at several sites in a given NogoR polypeptide. NogoR polypeptides may be branched, for example, as a result of ubiquitination, and they may be cyclic, with or without branching. Cyclic, branched, and branched cyclic NogoR polypeptides may result from posttranslational natural processes or may be made by synthetic methods. Modifications include acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristoylation, oxidation, pegylation, proteolytic processing, phosphorylation, prenylation, racemization, selenoylation, sulfation, transfer-RNA mediated addition of amino acids to proteins such as arginylation, and ubiquitination. (See, for instance, PROTEINS—STRUCTURE AND MOLECULAR PROPERTIES, 2nd Ed., T. E. Creighton, W. H. Freeman and Company, New York (1993); POSTTRANSLATIONAL COVALENT MODIFICATION OF PROTEINS, B. C. Johnson, Ed., Academic Press, New York, pgs. 1-12 (1983); Seifter et al., *Meth Enzymol* 182:626-646 (1990); Rattan et al., *Ann NY Acad Sci* 663:48-62 (1992)).

Anti-NogoR Antibodies

In one embodiment, the invention provides antibodies (e.g., antibodies comprising two heavy chains and two light chains linked together by disulfide bridges) that specifically bind NogoR (SEQ ID NO:2) or fragments or variants thereof, wherein the amino acid sequence of the heavy chain and the amino acid sequence of the light chain are the same as the amino acid sequence of a heavy chain and a light chain expressed by one or more scFvs or cell lines referred to in Table 1. In another embodiment, the invention provides antibodies (each consisting of two heavy chains and two light chains linked together by disulfide bridges to form an antibody) that specifically bind NogoR or fragments or variants thereof, wherein the amino acid sequence of the heavy chain or the amino acid sequence of the light chain are the same as the amino acid sequence of a heavy chain or a light chain expressed by one or more scFvs or cell lines referred to in Table 1. Immunospecific binding to NogoR polypeptides may be determined by immunoassays known in the art or described herein for assaying specific antibody-antigen binding. Molecules comprising, or alternatively consisting of, fragments or variants of these antibodies that specifically bind to NogoR are also encompassed by the invention, as are nucleic acid molecules encoding these antibodies molecules, fragments and/or variants (e.g., SEQ ID NOs:149-247).

In one embodiment of the present invention, antibodies that specifically bind to NogoR or a fragment or variant thereof, comprise a polypeptide having the amino acid sequence of any one of the heavy chains expressed by at least one of the scFvs or cell lines referred to in Table 1 and/or any one of the light chains expressed by at least one of the scFvs or cell lines referred to in Table 1.

In another embodiment of the present invention, antibodies that specifically bind to NogoR or a fragment or variant thereof, comprise a polypeptide having the amino acid sequence of any one of the VH domains of at least one of the scFvs referred to in Table 1 and/or any one of the VL domains of at least one of the scFvs referred to in Table 1. In preferred embodiments, antibodies of the present invention comprise the amino acid sequence of a VH domain and VL domain from a single scFv referred to in Table 1. In alternative embodiments, antibodies of the present invention comprise the amino acid sequence of a VH domain and a VL domain from different scFvs referred to in Table 1. Molecules comprising, or alternatively consisting of, antibody fragments or variants of the VH and/or VL domains of at least one of the scFvs referred to in Table 1 that specifically bind to NogoR are also encompassed by the invention, as are nucleic acid molecules encoding these VH and VL domains, molecules, fragments and/or variants.

The present invention also provides antibodies that specifically bind to a polypeptide, or polypeptide fragment or variant of NogoR, wherein said antibodies comprise, or alternatively consist of, a polypeptide having an amino acid sequence of any one, two, three, or more of the VH CDRs contained in a VH domain of one or more scFvs referred to in Table 1. In particular, the invention provides antibodies that specifically bind NogoR or fragments or variants thereof, comprising, or alternatively consisting of, a polypeptide having the amino acid sequence of a VH CDR1 contained in a VH domain of one or more scFvs referred to in Table 1. In another embodiment, antibodies that specifically bind NogoR, comprise, or alternatively consist of, a polypeptide having the amino acid sequence of a VH CDR2 contained in a VH domain of one or more scFvs referred to in Table 1. In a preferred embodiment, antibodies that specifically bind NogoR or fragments or variants thereof, comprise, or alternatively consist of a polypeptide having the amino acid sequence of a VH CDR3 contained in a VH domain of one or more scFvs referred to in Table 1. Molecules comprising, or alternatively consisting of, these antibodies, or antibody fragments or variants thereof, that specifically bind to NogoR or a NogoR fragment or variant thereof are also encompassed by the invention, as are nucleic acid molecules encoding these antibodies, molecules, fragments and/or variants (e.g., SEQ ID NOs:149-247).

The present invention also provides antibodies that specifically bind to a NogoR polypeptide or a polypeptide fragment or variant of NogoR, wherein said antibodies comprise, or alternatively consist of, a polypeptide having an amino acid sequence of any one, two, three, or more of the VL CDRs contained in a VL domain of one or more scFvs referred to in Table 1. In particular, the invention provides antibodies that specifically bind NogoR or a fragment or variant thereof, comprising, or alternatively consisting of, a polypeptide having the amino acid sequence of a VL CDR1 contained in a VL domain of one or more scFvs referred to in Table 1. In another embodiment, antibodies that specifically bind NogoR or a fragment or variant thereof, comprise, or alternatively consist of, a polypeptide having the amino acid sequence of a VL CDR2 contained in a VL domain of one or more scFvs referred to in Table 1. In a preferred embodiment, antibodies that specifically bind NogoR or a fragment or variant thereof, comprise, or alternatively consist of a polypeptide having the amino acid sequence of a VL CDR3 contained in a VL domain of one or more scFvs referred to in Table 1. Molecules comprising, or alternatively consisting of, these antibodies, or antibody fragments or variants thereof, that specifically bind to NogoR or a NogoR fragment or variant thereof are also encompassed by the invention, as are nucleic acid molecules encoding these antibodies, molecules, fragments and/or variants (e.g., SEQ ID NOs:149-247).

The present invention also provides antibodies (including molecules comprising, or alternatively consisting of, antibody fragments or variants) that specifically bind to the NogoR polypeptide or a fragment or variant of a NogoR, wherein said antibodies comprise, or alternatively consist of, one, two, three, or more VH CDRs and one, two, three or more VL CDRs, as contained in a VH domain or VL domain of one or more scFvs referred to in Table 1. In particular, the invention provides for antibodies that specifically bind to a NogoR polypeptide or polypeptide fragment or variant of NogoR, wherein said antibodies comprise, or alternatively consist of, a VH CDR1 and a VL CDR1, a VH CDR1 and a VL CDR2, a VH CDR1 and a VL CDR3, a VH CDR2 and a VL CDR1, VH CDR2 and VL CDR2, a VH CDR2 and a VL CDR3, a VH CDR3 and a VH CDR1, a VH CDR3 and a VL CDR2, a VH CDR3 and a VL CDR3, or any combination thereof, of the VH CDRs and VL CDRs contained in a VH domain or VL domain of one or more scFvs referred to in Table 1. In a preferred embodiment, one or more of these combinations are from the same scFv as disclosed in Table 1. Molecules comprising, or alternatively consisting of, fragments or variants of these antibodies, that specifically bind to NogoR or a fragment or variant thereof are also encompassed by the invention, as are nucleic acid molecules encoding these antibodies, molecules, fragments or variants (e.g., SEQ ID NOs:149-247).

Nucleic Acid Molecules Encoding Anti-NogoR Antibodies

The present invention also provides for nucleic acid molecules, generally isolated, encoding an antibody of the invention (including molecules comprising, or alternatively consisting of, antibody fragments or variants thereof). In specific embodiments, the nucleic acid molecules encoding an antibody of the invention comprise, or alternatively consist of SEQ ID NOs:149-247 or fragments or variants thereof.

In a specific embodiment, a nucleic acid molecule of the invention encodes an antibody (including molecules comprising, or alternatively consisting of, antibody fragments or variants thereof), comprising, or alternatively consisting of, a VH domain having an amino acid sequence of any one of the VH domains of at least one of the scFvs referred to in Table 1 and a VL domain having an amino acid sequence of VL domain of at least one of the scFvs referred to in Table 1. In another embodiment, a nucleic acid molecule of the invention encodes an antibody (including molecules comprising, or alternatively consisting of, antibody fragments or variants thereof), comprising, or alternatively consisting of, a VH domain having an amino acid sequence of any one of the VH domains of at least one of the scFvs referred to in Table 1 or a VL domain having an amino acid sequence of a VL domain of at least one of the scFvs referred to in Table 1.

The present invention also provides antibodies that comprise, or alternatively consist of, variants (including derivatives) of the antibody molecules (e.g., the VH domains and/or VL domains) described herein, which antibodies specifically bind to NogoR polypeptide, or fragments or variants thereof. Standard techniques known to those of skill in the art can be used to introduce mutations in the nucleotide sequence encoding a molecule of the invention, including, for example, site-directed mutagenesis and PCR-mediated mutagenesis which result in amino acid substitutions. Preferably, the variants (including derivatives) encode less than 50 amino acid substitutions, less than 40 amino acid substitutions, less than 30 amino acid substitutions, less than 25 amino acid substitutions, less than 20 amino acid substitutions, less than 15 amino acid substitutions, less than 10 amino acid substitutions, less than 5 amino acid substitutions, less than 4 amino acid substitutions, less than 3 amino acid substitutions, or less than 2 amino acid substitutions relative to the reference VH domain, VHCDR1, VHCDR2, VHCDR3, VL domain, VLCDR1, VLCDR2, or VLCDR3. A "conservative amino acid substitution" is one in which the amino acid residue is replaced with an amino acid residue having a side chain with a similar charge. Families of amino acid residues having side chains with similar charges have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Alternatively, mutations can be introduced randomly along all or part of the coding sequence, such as by saturation mutagenesis, and the resultant mutants can be screened for biological activity to identify mutants that retain activity (e.g. the ability to bind NogoR).

For example, it is possible to introduce mutations only in framework regions or only in CDR regions of an antibody molecule. Introduced mutations may be silent or neutral missense mutations, i.e., have no, or little, effect on an antibody's ability to bind antigen. These types of mutations may be useful to optimize codon usage, or improve a hybridoma's antibody production. Alternatively, non-neutral missense mutations may alter an antibody's ability to bind antigen. The location of most silent and neutral missense mutations is likely to be in the framework regions, while the location of most non-neutral missense mutations is likely to be in CDR, though this is not an absolute requirement. One of skill in the art would be able to design and test mutant molecules with desired properties such as no alteration in antigen binding activity or alteration in binding activity (e.g., improvements in antigen binding activity or change in antibody specificity). Following mutagenesis, the encoded protein may routinely be expressed and the functional and/or biological activity of the encoded protein, (e.g. ability to specifically bind NogoR) can be determined using techniques described herein or by routinely modifying techniques known in the art.

In a specific embodiment, an antibody of the invention (including a molecule comprising, or alternatively consisting of, an antibody fragment or variant thereof), that specifically binds NogoR or a fragment or variant thereof, comprises, or alternatively consists of, an amino acid sequence encoded by a nucleotide sequence that hybridizes to a nucleotide sequence that is complementary to that encoding one of the VH or VL domains of one or more scFvs referred to in Table 1 under stringent conditions, e.g., hybridization to filter-bound DNA in 6× sodium chloride/sodium citrate (SSC) at about 45° C. followed by one or more washes in 0.2×SSC/ 0.1% SDS at about 50-65° C., under highly stringent conditions, e.g., hybridization to filter-bound nucleic acid in 6×SSC at about 45° C. followed by one or more washes in 0.1×SSC/0.2% SDS at about 68° C., or under other stringent hybridization conditions which are known to those of skill in the art (see, for example, Ausubel, F. M. et al., eds., 1989, *Current Protocols in Molecular Biology*, Vol. 1, Green Publishing Associates, Inc. and John Wiley & Sons, Inc., New York at pages 6.3.1-6.3.6 and 2.10.3). The nucleic acid molecules encoding these antibodies are also encompassed by the invention.

It is well known within the art that polypeptides, or fragments or variants thereof, with similar amino acid sequences often have similar structure and many of the same biological activities. Thus, in one embodiment, an antibody (including a molecule comprising, or alternatively consisting of, an antibody fragment or variant thereof), that specifically binds to NogoR or fragments or variants of NogoR, comprises, or alternatively consists of, a VH domain having an amino acid sequence that is at least 35%, at least 40%, at least 45%, at least 50%, at least 55%, at least 60%, at least 65%, at least 70%, at least 75%, at least 80%, at least 85%, at least 90%, at least 95%, or at least 99% identical, to the amino acid sequence of a VH domain of at least one of the scFvs referred to in Table 1.

In another embodiment, an antibody (including a molecule comprising, or alternatively consisting of, an antibody fragment or variant thereof), that specifically binds to NogoR or a fragment or variant of NogoR, comprises, or alternatively consists of, a VL domain having an amino acid sequence that is at least 35%, at least 40%, at least 45%, at least 50%, at least 55%, at least 60%, at least 65%, at least 70%, at least 75%, at least 80%, at least 85%, at least 90%, at least 95%, or at least 99% identical, to the amino acid sequence of a VL domain of at least one of the scFvs referred to in Table I.

Methods of Producing Antibodies

Antibodies in accordance with the invention were prepared via the utilization of a phage scFv display library (See Example 1). Technologies utilized for achieving the same are disclosed in the patents, applications, and references disclosed herein.

In phage display methods, functional antibody domains are displayed on the surface of phage particles which carry the polynucleotide sequences encoding them. In particular, DNA sequences encoding VH and VL domains are amplified from animal cDNA libraries (e.g., human or murine cDNA libraries of lymphoid tissues) or synthetic cDNA libraries. The DNA encoding the VH and VL domains are joined together by an scFv linker by PCR and cloned into a phagemid vector (e.g., pCANTAB 6 or pComb 3 HSS). The vector is electroporated in *E. coli* and the *E. coli* is infected with helper phage. Phage used in these methods are typically filamentous phage including fd and M13 and the VH and VL domains are usually recombinantly fused to either the phage gene III or gene VIII. Phage expressing an antigen binding domain that binds to an antigen of interest (i.e., NogoR polypeptide or a fragment thereof) can be selected or identified with antigen, e.g., using labeled antigen or antigen bound or captured to a solid surface or bead. Examples of phage display methods that can be used to make the antibodies of the present invention include, but are not limited to, those disclosed in Brinkman et al., *J Immunol Meth* 182:41-50 (1995); Ames et al., *J Immunol Meth* 184:177-186 (1995); Kettleborough et al., *Eur J Immunol* 24:952-958 (1994); Persic et al., *Gene* 187:9-18 (1997); Burton et al., *Adv Immunol* 57:191-280 (1994); PCT Application No. PCT/GB91/01134; PCT publications WO 90/02809; WO 91/10737; WO 92/01047; WO 92/18719; WO 93/11236; WO 95/15982; WO 95/20401; WO97/13844; and U.S. Pat. Nos. 5,698,426; 5,223,409; 5,403,484; 5,580,717; 5,427,908; 5,750,753; 5,821,047; 5,571,698; 5,427,908; 5,516,717; 5,780,225; 5,658,727; 5,735,743 and 5,969,108; each of which is incorporated herein by reference in its entirety.

For some uses, such as for in vitro affinity maturation of an antibody of the invention, it may be useful to express the VH and VL domains of one or more scFvs referred to in Table 1 as single chain antibodies or Fab fragments in a phage display library. For example, the cDNAs encoding the VH and VL domains of the scFvs referred to in Table 1 may be expressed in all possible combinations using a phage display library, allowing for the selection of VH/VL combinations that bind NogoR polypeptides with preferred binding characteristics such as improved affinity or improved off rates. Additionally, VH and VL domains, and in particular, the CDR regions of the VH and VL domains of the scFvs referred to in Table 1, may be mutated in vitro. Expression of VH and VL domains with "mutant" CDRs in a phage display library allows for the selection of VH/VL combinations that bind NogoR polypeptides with preferred binding characteristics such as improved affinity or improved off rates.

Additional Methods of Producing Antibodies

Antibodies of the invention (including antibody fragments or variants) can be produced by any method known in the art. For example, it will be appreciated that antibodies in accordance with the present invention can be expressed in cell lines other than hybridoma cell lines. Sequences encoding the cDNAs or genomic clones for the particular antibodies can be used for transformation of a suitable mammalian or nonmammalian host cells or to generate phage display libraries, for example. Additionally, polypeptide antibodies of the invention may be chemically synthesized or produced through the use of recombinant expression systems.

One way to produce the antibodies of the invention would be to clone the VH and/or VL domains of the scFvs referred to in Table 1. In order to isolate the VH and VL domains from bacteria transfected with a vector containing the scFv, PCR primers complementary to VH or VL nucleotide sequences (See Example 2), may be used to amplify the VH and VL sequences. The PCR products may then be cloned using vectors, for example, which have a PCR product cloning site consisting of a 5' and 3' single T nucleotide overhang, that is complementary to the overhanging single adenine nucleotide added onto the 5' and 3' end of PCR products by many DNA polymerases used for PCR reactions. The VH and VL domains can then be sequenced using conventional methods known in the art. Alternatively, the VH and VL domains may be amplified using vector specific primers designed to amplify the entire scFv, (i.e., the VH domain, linker and VL domain).

The cloned VH and VL genes may be placed into one or more suitable expression vectors. By way of non-limiting example, PCR primers including VH or VL nucleotide sequences, a restriction site, and a flanking sequence to protect the restriction site may be used to amplify the VH or VL sequences. Utilizing cloning techniques known to those of skill in the art, the PCR amplified VH domains may be cloned into vectors expressing the appropriate immunoglobulin constant region, e.g., the human IgG, or IgG4 constant region for VH domains, and the human kappa or lambda constant regions for kappa and lambda VL domains, respectively. Preferably, the vectors for expressing the VH or VL domains comprise a promoter suitable to direct expression of the heavy and light chains in the chosen expression system, a secretion signal, a cloning site for the immunoglobulin variable domain, immunoglobulin constant domains, and a selection marker such as neomycin. The VH and VL domains may also be cloned into a single vector expressing the necessary constant regions. The heavy chain conversion vectors and light chain conversion vectors are then co-transfected into cell lines to generate stable or transient cell lines that express full-length antibodies, e.g., IgG, using techniques known to those of skill in the art (See, for example, Guo et al., *J Clin Endocrinol Metab* 82:925-31 (1997), and Ames et al., *J Immunol Meth* 184:177-86 (1995) which are herein incorporated in their entireties by reference). Polynucleotides encoding any of the VH or VL domains of the invention can be combined with sequences known in the art to generate an expression vector encoding an antibody molecule or portion thereof. For example, a polynucleotide sequence encoding a VH domain can be combined with a polynucleotide sequence encoding an immunoglobulin constant domain, such as a human IgG1 heavy chain constant domain or a human IgG4 heavy chain constant domain.

A polynucleotide sequence encoding a VL domain can be combined with a polynucleotide sequence encoding a an immunoglobulin constant domain, such as a human kappa light chain constant domain or a human lambda light chain constant domain.

The amino acid sequences of a human IgG1 heavy chain constant domain (SEQ ID NO:44), a human IgG4 heavy chain constant domain (SEQ ID NO:45) and a human kappa light chain constant domain (SEQ ID NO:46), and a human lambda constant domain (SEQ ID NO:47) are shown below. The expression vector for an antibody molecule can also encode a signal sequence at the N-terminal end of the sequences encoding the VH and/or VL domains to promote secretion into the culture medium. Examples of such signal sequences are provided below (SEQ ID NOs:48-49).

```
Human IgG1 Heavy Chain Constant Domain (SEQ ID NO: 44)
ASTKGPSVFP LAPSSKSTSG GTAALGCLVK DYFPEPVTVS WNSGALTSGV HTFPAVLQSS   60

GLYSLSSVVT VPSSSLGTQT YICNVNHKPS NTKVDKKVEP KSCDKTHTCP PCPAPELLGG  120

PSVFLFPPKP KDTLMISRTP EVTCVVVDVS HEDPEVKFNW YVDGVEVHNA KTKPREEQYN  180

STYRVVSVLT VLHQDWLNGK EYKCKVSNKA LPAPIEKTIS KAKGQPREPQ VYTLPPSRDE  240

LTKNQVSLTC LVKGFYPSDI AVEWESNGQP ENNYKTTPPV LDSDGSFFLY SKLTVDKSRW  300
```

```
QQGNVFSCSV MHEALHNHYT QKSLSLSPGK                                       330

Human IgG4 Heavy Chain Constant Domain (SEQ ID NO: 45)
ASTKGPSVFP LAPCSRSTSE STAALGCLVK DYFPEPVTVS WNSGALTSGV HTFPAVLQSS        60

GLYSLSSVVT VPSSSLGTKT YTCNVDHKPS NTKVDKRVES KYGPPCPSCP APEFLGGPSV       120

FLFPPKPKDT LMISRTPEVT CVVVDVSQED PEVQFNWYVD GVEVHNAKTK PREEQFNSTY       180

RVVSVLTVLH QDWLNGKEYK CKVSNKGLPS SIEKTISKAK GQPREPQVYT LPPSQEEMTK       240

NQVSLTCLVK GFYPSDIAVE WESNGQPENN YKTTPPVLDS DGSFFLYSRL TVDKSRWQEG       300

NVFSCSVMHE ALHNHYTQKS LSLSLGK                                          327

Human Kappa Constant Domain (SEQ ID NO: 46)
TVAAPSVFIF PPSDEQLKSG TASVVCLLNN FYPREAKVQW KVDNALQSGN SQESVTEQDS        60

KDSTYSLSST LTLSKADYEK HKVYACEVTH QGLSSPVTKS FNRGEC                     106

Human Lambda Constant Domain (SEQ ID NO: 47)
QPKAAPSVTL FPPSSEELQA NKATLVCLIS DFYPGAVTVA WKADSSPVKA GVETTTPSKQ        60

SNNKYAASSY LSLTPEQWKS HRSYSCQVTH EGSTVEKTVA PTECS                      105

Signal Peptides for Immunoglobulin Heavy or Light Chains
MGWSCIILFL VATATGAHS (SEQ ID NO: 48)                                    19

MGWSCIILFL VATATGVHS (SEQ ID NO: 49)                                    19
```

The invention provides polynucleotides comprising, or alternatively consisting of, a nucleotide sequence encoding an antibody of the invention (including molecules comprising, or alternatively consisting of, antibody fragments or variants thereof). The invention also encompasses polynucleotides that hybridize under high stringency, or alternatively, under intermediate or lower stringency hybridization conditions, e.g., as defined supra, to polynucleotides complementary to nucleic acids having a polynucleotide sequence that encodes an antibody of the invention or a fragment or variant thereof.

The polynucleotides may be obtained, and the nucleotide sequence of the polynucleotides determined, by any method known in the art. If the amino acid sequences of the VH domains, VL domains and CDRs thereof, are known, nucleotide sequences encoding these antibodies can be determined using methods well known in the art, i.e., the nucleotide codons known to encode the particular amino acids are assembled in such a way to generate a nucleic acid that encodes the antibody, of the invention. Such a polynucleotide encoding the antibody may be assembled from chemically synthesized oligonucleotides (e.g., as described in Kutmeier et al., *BioTechniques* 17:242 (1994)), which, briefly, involves the synthesis of overlapping oligonucleotides containing portions of the sequence encoding the antibody, annealing and ligating of those oligonucleotides, and then amplification of the ligated oligonucleotides by PCR.

Alternatively, a polynucleotide encoding an antibody (including molecules comprising, or alternatively consisting of, antibody fragments or variants thereof) may be generated from nucleic acid from a suitable source. If a clone containing a nucleic acid encoding a particular antibody is not available, but the sequence of the antibody molecule is known, a nucleic acid encoding the immunoglobulin may be chemically synthesized or obtained from a suitable source (e.g., an antibody cDNA library, or a cDNA library generated from, or nucleic acid, preferably poly A+ RNA, isolated from, any tissue or cells expressing the antibody, such as hybridoma cells or Epstein Barr virus transformed B cell lines that express an antibody of the invention) by PCR amplification using synthetic primers hybridizable to the 3' and 5' ends of the sequence or by cloning using an oligonucleotide probe specific for the particular gene sequence to identify, e.g., a cDNA clone from a cDNA library that encodes the antibody. Amplified nucleic acids generated by PCR may then be cloned into replicable cloning vectors using any method well known in the art.

Once the nucleotide sequence of the antibody (including molecules comprising, or alternatively consisting of, antibody fragments or variants thereof) is determined, the nucleotide sequence of the antibody may be manipulated using methods well known in the art for the manipulation of nucleotide sequences, e.g., recombinant DNA techniques, site directed mutagenesis, PCR, etc. (see, for example, the techniques described in Sambrook et al., 1990, Molecular Cloning, A Laboratory Manual, 2d Ed., Cold Spring Harbor Laboratory, Cold Spring Harbor, N.Y. and Ausubel et al., eds., 1998, Current Protocols in Molecular Biology, John Wiley & Sons, NY, which are both incorporated by reference herein in their entireties), to generate antibodies having a different amino acid sequence, for example to create amino acid substitutions, deletions, and/or insertions.

In a specific embodiment, VH and VL domains of one or more scFvs referred to in Table 1, or fragments or variants thereof, are inserted within framework regions using recombinant DNA techniques known in the art. In a specific embodiment, one, two, three, four, five, six, or more of the CDRs of VH and/or VL domains of one or more scFvs referred to in Table 1, or fragments or variants thereof, are inserted within framework regions using recombinant DNA techniques known in the art. The framework regions may be naturally occurring or consensus framework regions, and preferably human framework regions (see, e.g., Chothia et al., *J Mol Biol* 278: 457-479 (1998) for a listing of human framework regions, the contents of which are hereby incorporated by reference in its entirety). Preferably, the polynucleotides generated by the combination of the framework regions and CDRs encode an antibody (including molecules comprising, or alternatively consisting of, antibody fragments or variants thereof) that specifically binds to NogoR. Preferably, as discussed supra, polynucleotides encoding variants of antibodies or antibody fragments having one or more amino acid substitutions may be made within the framework regions, and, preferably, the amino acid substitutions do not significantly alter binding of the antibody to its antigen. Additionally, such methods may be used to make amino acid substitutions or deletions of one or more variable region cysteine residues participating in an intrachain disulfide bond to generate antibody molecules, or antibody fragments or variants, lacking one or more intrachain disulfide bonds. Other alterations to the polynucleotide are encompassed by the present invention and fall within the ordinary skill of the art.

The ability to clone and reconstruct megabase-sized human loci in YACs and to introduce them into the mouse germline provides a powerful approach to elucidating the functional components of very large or crudely mapped loci as well as generating useful models of human disease. Furthermore, the utilization of such technology for substitution of mouse loci with their human equivalents could provide unique insights into the expression and regulation of human gene products during development, their communication with other systems, and their involvement in disease induction and progression.

An important practical application of such a strategy is the "humanization" of the mouse humoral immune system. Introduction of human immunoglobulin (Ig) loci into mice in which the endogenous Ig genes have been inactivated offers the opportunity to study the mechanisms underlying programmed expression and assembly of antibodies as well as their role in B cell development. Furthermore, such a strategy could provide an ideal source for production of fully human monoclonal antibodies (mAbs) an important milestone towards fulfilling the promise of antibody therapy in human disease.

Fully human antibodies are expected to minimize the immunogenic and allergic responses intrinsic to mouse or mouse-derivatized monoclonal antibodies and thus to increase the efficacy and safety of the administered antibodies. The use of fully human antibodies can be expected to provide a substantial advantage in the treatment of chronic and recurring human diseases, such as cancer, which require repeated antibody administrations.

One approach towards this goal was to engineer mouse strains deficient in mouse antibody production with large fragments of the human Ig loci in anticipation that such mice would produce a large repertoire of human antibodies in the absence of mouse antibodies. Large human Ig fragments would preserve the large variable gene diversity as well as the proper regulation of antibody production and expression. By exploiting the mouse machinery for antibody diversification and selection and the lack of immunological tolerance to human proteins, the reproduced human antibody repertoire in these mouse strains should yield high affinity antibodies against any antigen of interest, including human antigens. Using the hybridoma technology, antigen-specific human monoclonal antibodies with the desired specificity could be readily produced and selected.

This general strategy was demonstrated in connection with the generation of the first XENOMOUSE™ strains as published in 1994 (See Green et al., *Nature Genetics* 7:13-21 (1994)). The XENOMOUSE™ strains were engineered with yeast artificial chromosomes (YACS) containing germline configuration fragments of the human heavy chain locus and kappa light chain locus, respectively, which contained core variable and constant region sequences (Id.). The human Ig containing YACs proved to be compatible with the mouse system for both rearrangement and expression of antibodies and were capable of substituting for the inactivated mouse Ig genes. This was demonstrated by their ability to induce B-cell development, to produce an adult-like human repertoire of fully human antibodies, and to generate antigen-specific human monoclonal antibodies. These results also suggested that introduction of larger portions of the human Ig loci containing greater numbers of V genes, additional regulatory elements, and human Ig constant regions might recapitulate substantially the full repertoire that is characteristic of the human humoral response to infection and immunization. The work of Green et al. was recently extended to the introduction of greater than approximately 80% of the human antibody repertoire through introduction of megabase sized, germline configuration YAC fragments of the human heavy chain loci and kappa light chain loci, respectively, to produce XENOMOUSE™ mice. See Mendez et al., *Nature Genetics* 15:146-156 (1997), Green and Jakobovits, *J Exp Med* 188:483-495 (1998), Green, *J Immunol Meth* 231:11-23 (1999) and U.S. patent application Ser. No. 08/759,620, filed Dec. 3, 1996, the disclosures of which are hereby incorporated by reference.

Such approach is further discussed and delineated in U.S. patent application Ser. No. 07/466,008, filed Jan. 12, 1990, Ser. No. 07/710,515, filed Nov. 8, 1990, Ser. No. 07/919,297, filed Jul. 24, 1992, Ser. No. 07/922,649, filed Jul. 30, 1992, filed 08/031,801, filed Mar. 15, 1993, Ser. No. 08/112,848, filed Aug. 27, 1993, Ser. No. 08/234,145, filed Apr. 28, 1994, Ser. No. 08/376,279, filed Jan. 20, 1995, Ser. No. 08/430,938, Apr. 27, 1995, 0-8/464,584, filed Jun. 5, 1995, Ser. No. 08/464,582, filed Jun. 5, 1995, Ser. No. 08/471,191, filed Jun. 5, 1995, Ser. No. 08/462,837, filed Jun. 5, 1995, Ser. No. 08/486,853, filed Jun. 5, 1995, Ser. No. 08/486,857, filed Jun. 5, 1995, Ser. No. 08/486,859, filed Jun. 5, 1995, Ser. No. 08/462,513, filed Jun. 5, 1995, Ser. No. 08/724,752, filed Oct. 2, 1996, and Ser. No. 08/759,620, filed Dec. 3, 1996. See also Mendez et al., *Nature Genetics* 15:146-156 (1997) and Green and Jakobovits, *J Exp Med* 188:483-495 (1998). See also European Patent No., EP 0 463 151 B1, granted Jun. 12, 1996, International Patent Application No., WO 94/02602, published Feb. 3, 1994, International Patent Application No., WO 96/34096, published Oct. 31, 1996, WO 98/24893, published Jun. 11, 1998 and U.S. Patent Application Publication Nos. 2002/0199213 and 2003/0091995. The disclosures of each of the above-cited patents, applications, and references are hereby incorporated by reference in their entirety.

Human anti-mouse antibody (HAMA) responses have led the industry to prepare chimeric or otherwise humanized antibodies. While chimeric antibodies have a human constant region and a murine variable region, it is expected that certain human anti-chimeric antibody (HACA) responses will be observed, particularly in chronic or multi-dose utilizations of the antibody. Thus, it would be desirable to provide fully human antibodies against NogoR in order to vitiate concerns and/or effects of HAMA or HACA responses.

Monoclonal antibodies specific for NogoR may be prepared using hybridoma technology (Kohler et al., *Nature* 256:495 (1975); Kohler et al., *Eur J Immunol* 6:511 (1976); Kohler et al., *Eur J Immunol* 6:292 (1976); Hammerling et al., in: Monoclonal Antibodies and T-Cell Hybridomas, Elsevier, N.Y., pp. 571-681 (1981)). Briefly, XENOMOUSE™ mice may be immunized with NogoR. After immunization, the splenocytes of such mice are extracted and fused with a suitable myeloma cell line. Any suitable myeloma cell line, such as the myeloma cell line (SP2O), available from the ATCC™, may be employed in accordance with the present invention; however, it is preferable to employ the parent myeloma cell line (SP2O), available from the ATCC™. After fusion, the resulting hybridoma cells are selectively maintained in HAT medium, and then cloned by limiting dilution as described by Wands et al. *Gastroenterology* 80:225-232

(1981). The hybridoma cells obtained through such a selection are then assayed to identify clones which secrete antibodies capable of binding NogoR.

For some uses, including in vivo use of antibodies in humans and in vitro detection assays, it may be preferable to use human or chimeric antibodies. Completely human antibodies are particularly desirable for therapeutic treatment of human patients. See also, U.S. Pat. Nos. 4,444,887 and 4,716,111; and PCT publications WO 98/46645, WO 98/50435, WO 98/24893, WO98/16654, WO 96/34096, WO 96/35735, and WO 91/10741; each of which is incorporated herein by reference in its entirety. In a specific embodiment, antibodies of the present invention comprise one or more VH and VL domains of the invention and constant regions from another immunoglobulin molecule, preferably a human immunoglobulin molecule. In a specific embodiment, antibodies of the present invention comprise one or more CDRs corresponding to the VH and VL domains of the invention and framework regions from another immunoglobulin molecule, preferably a human immunoglobulin molecule. In other embodiments, an antibody of the present invention comprises one, two, three, four, five, six or more VL CDRs or VH CDRs having amino acid sequences of VH CDRs or VL CDRs of one or more of the VH or VL domains of one or more scFvs referred to in Table 1, or fragments or variants thereof, and framework regions (and, optionally one or more CDRs not derived from the antibodies expressed by scFvs referred to in Table 1, respectively) from a human immunoglobulin molecule. In a preferred embodiment, an antibody of the present invention comprises a VH CDR3, VL CDR3, or both, having an amino acid sequence of a VH CDR3 and/or a VL CDR3 of one or more scFvs selected from the scFvs referred to in Table 1, or fragments or variants thereof, and framework regions from a human immunoglobulin.

A chimeric antibody is a molecule in which different portions of the antibody are derived from different immunoglobulin molecules such as antibodies having a variable region derived from a human antibody and a non-human (e.g., murine) immunoglobulin constant region or vice versa. Methods for producing chimeric antibodies are known in the art. See e.g., Morrison, *Science* 229:1202 (1985); Oi et al., *BioTechniques* 4:214 (1986); Gillies et al., *J Immunol Methods* 125:191-202 (1989); U.S. Pat. Nos. 5,807,715; 4,816,567; and 4,816,397, which are incorporated herein by reference in their entirety. Chimeric antibodies comprising one or more CDRs from human species and framework regions from a non-human immunoglobulin molecule (e.g., framework regions from a murine, canine or feline immunoglobulin molecule) (or vice versa) can be produced using a variety of techniques known in the art including, for example, CDR-grafting (EP 239,400; PCT publication WO 91/09967; U.S. Pat. Nos. 5,225,539; 5,530,101; and 5,585,089), veneering or resurfacing (EP 592,106; EP 519,596; Padlan, *Molecular Immunology* 28:489-498 (1991); Studnicka et al., *Protein Engineering* 7:805-814 (1994); Roguska et al., *Proc Natl Acad Sci USA* 91:969-973 (1994)), and chain shuffling (U.S. Pat. No. 5,565,352). In a preferred embodiment, chimeric antibodies comprise a human CDR3 having an amino acid sequence of any one of the VH CDR3s or VL CDR3s of a VH or VL domain of one or more of the scFvs referred to in Table 1, or a variant thereof, and non-human framework regions or human framework regions different from those of the frameworks in the corresponding scFv disclosed in Table 1. Often, framework residues in the framework regions will be substituted with the corresponding residue from the CDR donor antibody to alter, preferably improve, antigen binding. These framework substitutions are identified by methods well known in the art, e.g., by modeling of the interactions of the CDR and framework residues to identify framework residues important for antigen binding and sequence comparison to identify unusual framework residues at particular positions. (See, e.g., Queen et al., U.S. Pat. No. 5,585,089; Riechmann et al., *Nature* 352:323 (1988), which are incorporated herein by reference in their entireties.)

Intrabodies are antibodies, often scFvs, that are expressed from a recombinant nucleic acid molecule and engineered to be retained intracellularly (e.g., retained in the cytoplasm, endoplasmic reticulum, or periplasm). Intrabodies may be used, for example, to ablate the function of a protein to which the intrabody binds. The expression of intrabodies may also be regulated through the use of inducible promoters in the nucleic acid expression vector comprising the intrabody. Intrabodies of the invention can be produced using methods known in the art, such as those disclosed and reviewed in Chen et al., *Hum Gene Therap* 5:595-601 (1994); Marasco, *Gene Ther* 4:11-15 (1997); Rondon and Marasco, *Ann Rev Microbiol* 51:257-283 (1997); Proba et al., *J Mol Biol* 275:245-253 (1998); Cohen et al., *Oncogene* 17:2445-2456 (1998); Ohage and Steipe, *J Mol Biol* 291:1119-1128 (1999); Ohage et al., *J Mol Biol* 291:1129-1134 (1999); Wirtz and Steipe, *Protein Sci* 8:2245-2250 (1999); Zhu et al., *J Immunol Methods* 231:207-222 (1999); and references cited therein.

Recombinant expression of an antibody of the invention (including antibody fragments or variants thereof (e.g., a heavy or light chain of an antibody of the invention)) requires construction of an expression vector(s) containing a polynucleotide that encodes the antibody. Once a polynucleotide encoding an antibody molecule (e.g., a whole antibody, a heavy or light chain of an antibody, or portion thereof (preferably, but not necessarily, containing the heavy or light chain variable domain)) of the invention has been obtained, the vector(s) for the production of the antibody molecule may be produced by recombinant DNA technology using techniques well known in the art. Thus, methods for preparing a protein by expressing a polynucleotide containing an antibody encoding nucleotide sequence are described herein. Methods which are well known to those skilled in the art can be used to construct expression vectors containing antibody coding sequences and appropriate transcriptional and translational control signals. These methods include, for example, in vitro recombinant DNA techniques, synthetic techniques, and in vivo genetic recombination. The invention, thus, provides replicable vectors comprising a nucleotide sequence encoding an antibody molecule of the invention (e.g., a whole antibody, a heavy or light chain of an antibody, a heavy or light chain variable domain of an antibody, or a portion thereof, or a heavy or light chain CDR, a single chain Fv, or fragments or variants thereof), operably linked to a promoter. Such vectors may include the nucleotide sequence encoding the constant region of the antibody molecule (see, e.g., PCT Publication WO 86/05807; PCT Publication WO 89/01036; and U.S. Pat. No. 5,122,464, the contents of each of which are hereby incorporated by reference in its entirety) and the variable domain of the antibody may be cloned into such a vector for expression of the entire heavy chain, the entire light chain, or both the entire heavy and light chains.

The expression vector(s) is(are) transferred to a host cell by conventional techniques and the transfected cells are then cultured by conventional techniques to produce an antibody of the invention. Thus, the invention includes host cells containing polynucleotide(s) encoding an antibody of the invention (e.g. whole antibody, a heavy or light chain thereof, or portion thereof, or a single chain antibody, or a fragment or variant thereof), operably linked to a heterologous promoter.

In preferred embodiments, for the expression of entire antibody molecules, vectors encoding both the heavy and light chains may be co-expressed in the host cell for expression of the entire immunoglobulin molecule, as detailed below.

A variety of host-expression vector systems may be utilized to express the antibody molecules of the invention. Such host-expression systems represent vehicles by which the coding sequences of interest may be produced and subsequently purified, but also represent cells which may, when transformed or transfected with the appropriate nucleotide coding sequences, express an antibody molecule of the invention in situ. These include, but are not limited to, bacteriophage particles engineered to express antibody fragments or variants thereof (single chain antibodies), microorganisms such as bacteria (e.g., E. coli, B. subtilis) transformed with recombinant bacteriophage DNA, plasmid DNA or cosmid DNA expression vectors containing antibody coding sequences; yeast (e.g., Saccharomyces, Pichia) transformed with recombinant yeast expression vectors containing antibody coding sequences; insect cell systems infected with recombinant virus expression vectors (e.g. baculovirus) containing antibody coding sequences; plant cell systems infected with recombinant virus expression vectors (e.g., cauliflower mosaic virus, CaMV; tobacco mosaic virus, TMV) or transformed with recombinant plasmid expression vectors (e.g., Ti plasmid) containing antibody coding sequences; or mammalian cell systems (e.g., COS, CHO, BHK, 293, 3T3, NS0 cells) harboring recombinant expression constructs containing promoters derived from the genome of mammalian cells (e.g., metallothionein promoter) or from mammalian viruses (e.g., the adenovirus late promoter; the vaccinia virus 7.5 K promoter). Preferably, bacterial cells such as E. coli, and more preferably, eukaryotic cells, especially for the expression of whole recombinant antibody molecule, are used for the expression of a recombinant antibody molecule. For example, mammalian cells such as Chinese hamster ovary cells (CHO), in conjunction with a vector such as the major intermediate early gene promoter element from human cytomegalovirus is an effective expression system for antibodies (Foecking et al., Gene 45:101 (1986); Cockett et al., BioTechnology 8:2 (1990); Bebbington et al., BioTechniques 10:169 (1992); Keen and Hale, Cytotechnology 18:207 (1996)). These references are incorporated in their entireties by reference herein.

In bacterial systems, a number of expression vectors may be advantageously selected depending upon the use intended for the antibody molecule being expressed. For example, when a large quantity of such a protein is to be produced, for the generation of pharmaceutical compositions of an antibody molecule, vectors which direct the expression of high levels of fusion protein products that are readily purified may be desirable. Such vectors include, but are not limited to, the E. coli expression vector pUR278 (Ruther et al., EMBO 2:1791 (1983)), in which the antibody coding sequence may be ligated individually into the vector in frame with the lacZ coding region so that a fusion protein is produced; pIN vectors (Inouye & Inouye, Nucleic Acids Res 13:3101-3109 (1985); Van Heeke & Schuster, J Biol Chem 24:5503-5509 (1989)); and the like. pGEX vectors may also be used to express foreign polypeptides as fusion proteins with glutathione 5-transferase (GST). In general, such fusion proteins are soluble and can easily be purified from lysed cells by adsorption and binding to matrix glutathione agarose beads followed by elution in the presence of free glutathione. The pGEX vectors are designed to include thrombin or factor Xa protease cleavage sites so that the cloned target gene product can be released from the GST moiety.

In an insect system, Autographa californica nuclear polyhedrosis virus (AcNPV) may be used as a vector to express foreign genes. The virus grows in Spodoptera frugiperda cells. Antibody coding sequences may be cloned individually into non-essential regions (for example, the polyhedrin gene) of the virus and placed under control of an AcNPV promoter (for example, the polyhedrin promoter).

In mammalian host cells, a number of viral-based expression systems may be utilized. In cases where an adenovirus is used as an expression vector, the antibody coding sequence of interest may be ligated to an adenovirus transcription/translation control complex, e.g., the late promoter and tripartite leader sequence. This chimeric gene may then be inserted in the adenovirus genome by in vitro or in vivo recombination. Insertion in a non-essential region of the viral genome (e.g., region E1 or E3) will result in a recombinant virus that is viable and capable of expressing the antibody molecule in infected hosts (e.g., see Logan & Shenk, Proc Natl Acad Sci USA 81:3655-59 (1984)). Specific initiation signals may also be required for efficient translation of inserted antibody coding sequences. These signals include the ATG initiation codon and adjacent sequences. Furthermore, the initiation codon must be in phase with the reading frame of the desired coding sequence to ensure translation of the entire insert. These exogenous translational control signals and initiation codons can be of a variety of origins, both natural and synthetic. The efficiency of expression may be enhanced by the inclusion of appropriate transcription enhancer elements, transcription terminators, etc. (see, e.g., Bittner et al., Meth Enzymol 153:51-544 (1987)).

In addition, a host cell strain may be chosen which modulates the expression of the inserted sequences, or modifies and processes the gene product in the specific fashion desired. Such modifications (e.g., glycosylation) and processing (e.g., cleavage) of protein products may be important for the function of the protein. Different host cells have characteristic and specific mechanisms for the post-translational processing and modification of proteins and gene products. Appropriate cell lines or host systems can be chosen to ensure the correct modification and processing of the foreign protein expressed. To this end, eukaryotic host cells which possess the cellular machinery for proper processing of the primary transcript, glycosylation, and phosphorylation of the gene product may be used. Such mammalian host cells include, but are not limited to, CHO, VERY, BHK, HeLa, COS, NSO, MDCK, 293, 3T3, W138, and in particular, breast cancer cell lines such as, for example, BT483, Hs578T, HTB2, BT2O and T47D, and normal mammary gland cell line such as, for example, CRL7O3O and HsS78Bst.

For long-term, high-yield production of recombinant proteins, stable expression is preferred. For example, cell lines which stably express the antibody may be engineered. Rather than using expression vectors which contain viral origins of replication, host cells can be transformed with DNA controlled by appropriate expression control elements (e.g., promoter, enhancer, sequences, transcription terminators, polyadenylation sites, etc.) and a selectable marker. Following the introduction of the foreign DNA, engineered cells may be allowed to grow for 1-2 days in an enriched media, and then are switched to a selective media. The selectable marker in the recombinant plasmid confers resistance to the selection and allows cells to stably integrate the plasmid into their chromosomes and grow to form foci which in turn can be cloned and expanded into cell lines. This method may advantageously be used to engineer cell lines which express the antibody molecule. Such engineered cell lines may be particularly useful in screening and evaluation of compositions that interact directly or indirectly with the antibody molecule.

A number of selection systems may be used, including but not limited to, the herpes simplex virus thymidine kinase (Wigler et al., *Cell* 11:223 (1977)), hypoxanthineguanine phosphoribosyltransferase (Szybalska & Szybalski, *Proc Nail Acad Sci USA* 48:202 (1992)), and adenine phosphoribosyltransferase (Lowy et al., *Cell* 22:8-17 (1980)) genes can be employed in tk-, hgprt- or aprt-cells, respectively. Also, anti-metabolite resistance can be used as the basis of selection for the following genes: dhfr, which confers resistance to methotrexate (Wigler et al., *Proc Natl Acad Sci USA* 77:357 (1980); O'Hare et al., *Proc Natl Acad Sci USA* 78:1527 (1981)); gpt, which confers resistance to mycophenolic acid (Mulligan & Berg, *Proc Natl Acad Sci USA* 78:2072 (1981)); neo, which confers resistance to the aminoglycoside G418 (Clinical Pharmacy 12:488-505; Wu & Wu, *Biotherapy* 3:87-95 (1991); Tolstoshev, *Ann Rev Pharmacol Toxicol* 32:573-596 (1993); Mulligan, *Science* 260:926-932 (1993); and Morgan & Anderson, *Ann Rev Biochem* 62: 191-217 (1993); *TIB TECH* 11(5):155-2 (1993)); and hygro, which confers resistance to hygromycin (Santerre et al., *Gene* 30:147 (1984)). Methods commonly known in the art of recombinant DNA technology may be routinely applied to select the desired recombinant clone, and such methods are described, for example, in Ausubel et al. (eds.), Current Protocols in Molecular Biology, John Wiley & Sons, NY (1993); Kriegler, Gene Transfer and Expression, A Laboratory Manual, Stockton Press, NY (1990); and in Chapters 12 and 13, Dracopoli et al. (eds), Current Protocols in Human Genetics, John Wiley & Sons, NY (1994); Colberre-Garapin et al., *J Mol Biol* 150:1 (1981), which are incorporated by reference herein in their entireties.

The expression levels of an antibody molecule can be increased by vector amplification (for a review, see Bebbington and Hentschel, "The use of vectors based on gene amplification for the expression of cloned genes in mammalian cells" in *DNA Cloning*, Vol. 3. (Academic Press, New York, 1987)). When a marker in the vector system expressing antibody is amplifiable, increase in the level of inhibitor present in culture of host cell will increase the number of copies of the marker gene. Since the amplified region is associated with the coding sequence of the antibody, production of the antibody will also increase (Crouse et al., *Mol Cell Biol* 3:257 (1983)).

Vectors which use glutamine synthase (GS) or DHFR as the selectable markers can be amplified in the presence of the drugs methionine sulphoximine or methotrexate, respectively. An advantage of glutamine synthase based vectors is the availability of cell lines (e.g., the murine myeloma cell line, NS0) which are glutamine synthase negative. Glutamine synthase expression systems can also function in glutamine synthase expressing cells (e.g., CHO cells) by providing additional inhibitor to prevent the functioning of the endogenous gene. A glutamine synthase expression system and components thereof are detailed in PCT publications: WO87/04462; WO86/05807; WO89/01036; WO89/10404; and WO91/06657 which are incorporated in their entireties by reference herein. Additionally, glutamine synthase expression vectors that may be used according to the present invention are commercially available from suppliers, including, for example, Lonza Biologics, Inc. (Portsmouth, N.H.). Expression and production of monoclonal antibodies using a glutamine synthase expression system in murine myeloma cells is described in Bebbington et al., *Biotechnology* 10:169-175 (1992) and in Biblia and Robinson, *Biotechnol Prog* 11:1 (1995), which are incorporated in their entireties by reference herein.

The host cell may be co-transfected with two expression vectors of the invention, the first vector encoding a heavy chain derived polypeptide and the second vector encoding a light chain derived polypeptide. The two vectors may contain identical selectable markers which enable equal expression of heavy and light chain polypeptides. Alternatively, a single vector may be used which encodes, and is capable of expressing, both heavy and light chain polypeptides. In such situations, the light chain is preferably placed before the heavy chain to avoid an excess of toxic free heavy chain (Proudfoot, *Nature* 322:52 (1986); Kohler, *Proc Natl Acad Sci USA* 77:2197-2199 (1980)). The coding sequences for the heavy and light chains may comprise cDNA or genomic DNA.

Once an antibody molecule of the invention (including molecules comprising, or alternatively consisting of, antibody fragments or variants thereof) has been chemically synthesized or recombinantly expressed, it may be purified by any method known in the art for purification of an immunoglobulin molecule, or more generally, a protein molecule, such as, for example, by chromatography (e.g., ion exchange, affinity, particularly by affinity for the specific antigen after Protein A, and sizing column chromatography), centrifugation, differential solubility, or by any other standard technique for the purification of proteins. Further, the antibodies of the present invention may be fused to heterologous polypeptide sequences described herein or otherwise known in the art, to facilitate purification.

Characterization of Anti-NogoR Antibodies

Antibodies of the present invention (including molecules comprising, or alternatively consisting of, antibody fragments or variants thereof) may also be described or specified in terms of their binding to NogoR or fragments or variants of NogoR. In specific embodiments, antibodies of the invention bind NogoR, or fragments or variants thereof, with a dissociation constant or $K_D$ of less than or equal to $5\times10^{-2}$ M, $10^{-2}$ M, $5\times10^{-3}$ M, $10^{-3}$ M, $5\times10^{-4}$ M, $10^{-4}$ M, $5\times10^{-5}$ M, or $10^{-5}$ M. More preferably, antibodies of the invention bind NogoR or fragments or variants thereof with a dissociation constant or $K_D$ less than or equal to $5\times10^{-6}$ M, $10^{-6}$ M, $5\times10^{-7}$ M, $10^{-7}$M, $5\times10^{-8}$ M, or $10^{-8}$ M. Even more preferably, antibodies of the invention bind NogoR or fragments or variants thereof with a dissociation constant or $K_D$ less than or equal to $5\times10^{-9}$ M, $10^{-9}$ M, $5\times10^{-10}$ M, $10^{-10}$, $5\times10^{-11}$ M, $10^{-11}$ M, $5\times10^{-12}$ M, $10^{-12}$ M, $5\times^{-13}$ M, $10^{-13}$ M, $5\times10^{-14}$ M, $10^{-14}$ M, $5\times10^{-15}$ M, or $10^{-15}$ M. The invention encompasses antibodies that bind NogoR with a dissociation constant or $K_D$ that is within any one of the ranges that are between each of the individual recited values.

In specific embodiments, antibodies of the invention bind NogoR or fragments or variants thereof with an off rate ($k_{off}$) of less than or equal to $5\times10^{-2}$ sec$^{-1}$, $10^{-2}$ sec$^{-1}$, $5\times10^{-3}$ sec$^{-1}$ or $10^{-3}$ sec$^{-1}$. More preferably, antibodies of the invention bind NogoR or fragments or variants thereof with an off rate ($Q_{off}$) less than or equal to $5\times10^{-4}$ sec$^{-1}$, $10^{-4}$ sec$^{-1}$, $5\times10^{-5}$ sec$^{-1}$, or $10^{-5}$ sec$^{-1}$ $5\times10^{-6}$ sec$^{-1}$ $10^{-6}$ sec$^{-1}$, $5\times10^{-7}$ sec$^{-1}$ or $10^{-7}$ sec$^{-1}$. The invention encompasses antibodies that bind NogoR with an off rate ($k_{off}$) that is within any one of the ranges that are between each of the individual recited values.

In other embodiments, antibodies of the invention bind NogoR or fragments or variants thereof with an on rate (k-n) of greater than or equal to $10^3$ M$^{-1}$ sec$^{-1}$, $5\times10^3$ M$^{-1}$ sec$^{-1}$, $10^4$ M$^{-1}$ sect or $5\times10^4$ M$^{-1}$ sec$^{-1}$. More preferably, antibodies of the invention bind NogoR or fragments or variants thereof with an on rate ($k_{on}$) greater than or equal to $10^5$ M$^{-1}$ sec$^{-1}$, $5\times10^5$ M$^{-1}$ sec$^{-1}$, $10^6$ M$^{-1}$ sec$^{-1}$, or $5\times10^6$ M$^{-1}$ sec$^{-1}$ or $10^7$M$^{-1}$ sec$^{-1}$. The invention encompasses antibodies that bind NogoR with on rate ($k_{on}$) that is within any one of the ranges that are between each of the individual recited values.

In preferred embodiments, the antibodies of the present invention (including molecules comprising, or alternatively consisting of, antibody fragments or variants thereof), specifically bind to NogoR and do not cross-react with any other antigens. In preferred embodiments, the antibodies of the invention specifically bind to NogoR (e.g., SEQ ID NO:2 or fragments or variants thereof) and do not cross-react with other antigens present on the surface of cells of the nervous system.

In another embodiment, the antibodies of the present invention (including molecules comprising, or alternatively consisting of, antibody fragments or variants thereof), bind to NogoR and cross-react with other antigens. In other embodiments, the antibodies of the invention bind to NogoR (e.g., SEQ ID NO:2 or fragments or variants thereof) and cross-react with the antigens that are at least 50%, 60%, 70%, 80%, 90% or 95% identical to all or a fragment of NogoR, wherein said fragment is at least 30 amino acids in length.

In a preferred embodiment, antibodies of the invention preferentially bind NogoR (SEQ ID NO:2), or fragments and variants thereof relative to their ability to bind other antigens (e.g., p75(NTR) receptor and/or LINGO-1). An antibody's ability to preferentially bind one antigen compared to another antigen may be determined using any method known in the art.

By way of non-limiting example, an antibody may be considered to bind a first antigen preferentially if it binds said first antigen with a dissociation constant ($K_D$) that is less than the antibody's $K_D$ for the second antigen. In another non-limiting embodiment, an antibody may be considered to bind a first antigen preferentially if it binds said first antigen with an affinity (i.e., $K_D$) that is at least one order of magnitude less than the antibody's $K_D$ for the second antigen. In another non-limiting embodiment, an antibody may be considered to bind a first antigen preferentially if it binds said first antigen with an affinity (i.e., $K_D$) that is at least two orders of magnitude less than the antibody's $K_D$ for the second antigen.

In another non-limiting embodiment, an antibody may be considered to bind a first antigen preferentially if it binds said first antigen with an off rate ($k_{off}$) that is less than the antibody's $k_{off}$ for the second antigen. In another non-limiting embodiment, an antibody may be considered to bind a first antigen preferentially if it binds said first antigen with a $k_{off}$ that is at least one order of magnitude less than the antibody's $k_{off}$ for the second antigen. In another non-limiting embodiment, an antibody may be considered to bind a first antigen preferentially if it binds said first antigen with a $k_{off}$ that is at least two orders of magnitude less than the antibody's $k_{off}$ for the second antigen.

The invention also encompasses antibodies (including molecules comprising, or alternatively consisting of, antibody fragments or variants thereof) that have one or more of the same biological characteristics as one or more of the antibodies described herein. By "biological characteristics" is meant, the in vitro or in vivo activities or properties of the antibodies. Optionally, the antibodies of the invention will bind to the same epitope or an overlapping or closely associated epitope as the epitope bound by at least one of the antibodies specifically referred to herein. Such epitope binding can be routinely determined using assays known in the art. See, e.g., Harlow et al., Antibodies: A Laboratory Manual, (Cold Spring Harbor Laboratory Press, 2nd ed., pp. 567-569 (1988) (incorporated by reference herein in its entirety).

The present invention also provides for antibodies (including molecules comprising, or alternatively consisting of, antibody fragments or variants thereof) that inhibit or abolish biological activities of NogoR. By "biological activities of NogoR" is meant, for example, the ability of NogoR to bind a ligand, i.e., Nogo, OMgp, or MAG (See, for example, Example 3); the ability of NogoR to multimerize; the ability to interact with p75(NTR) and/or LINGO-1; the ability to induce apoptotic cell death; the ability to transduce a signal into a nerve cell; and/or the ability to inhibit neurite outgrowth or growth cone collapse in vitro. Exemplary assays for measuring NogoR activity and/or the ability of antagonists to inhibit NogoR activity are known in the art and can be found in, for example, Example 3, Foumier et al., *J Neurosci* 22:8876-8883 (2002), Fournier et al., *Nature* 409:341-346 (2001), Domeniconi et al., *Neuron* 35:283-290 (2002), or Grandpre et al., *Nature* 417:547-551 (2002). In one embodiment, an antibody that inhibits or abolishes biological activities of NogoR comprises, or alternatively consists of a VH and/or a VL domain of at least one of the scFvs referred to in Table 1, respectively, or a fragment or variant thereof. In a specific embodiment, an antibody that inhibits or abolishes biological activities of NogoR comprises, or alternatively consists of, a VH and a VL domain of any one of the scFvs referred to in Table 1, respectively, or a fragment or variant thereof. Nucleic acid molecules encoding these antibodies are also encompassed by the invention.

The present invention also provides for antibodies (including molecules comprising, or alternatively consisting of, antibody fragments or variants thereof), that prevents or inhibits the interaction of NogoR with p75(NTR) and/or LINGO-1. In one embodiment, an antibody that prevents or inhibits the interaction of NogoR with p75(NTR) and/or LINGO-1 comprises, or alternatively consists of a VH and/or a VL domain of at least one of the scFvs referred to in Table 1, or a fragment or variant thereof. In a specific embodiment, an antibody that prevents or inhibits the interaction of NogoR with p75(NTR) and/or LINGO-1 comprises, or alternatively consists of, a VH and a VL domain of any one of the scFvs referred to in Table 1, or a fragment or variant thereof. Nucleic acid molecules encoding these antibodies are also encompassed by the invention.

The present invention also provides for antibodies (including molecules comprising, or alternatively consisting of, antibody fragments or variants thereof), that block or inhibit the binding of NogoR to a NogoR ligand (e.g., Nogo-A, OMgp, or MAG). In one embodiment, an antibody that blocks or inhibits the binding of NogoR to a NogoR ligand (e.g., Nogo-A, OMgp, or MAG) comprises, or alternatively consists of, a VH and/or a VL domain of at least one of the scFvs referred to in Table 1, or a fragment or variant thereof. In a specific embodiment, an antibody that blocks or inhibits the binding of NogoR to a NogoR ligand (e.g., Nogo-A, OMgp, or MAG) comprises, or alternatively consists of, a VH and a VL domain of any one of the scFvs referred to in Table 1, or a fragment or variant thereof. Nucleic acid molecules encoding these antibodies are also encompassed by the invention.

The present invention also provides for antibodies (including molecules comprising, or alternatively consisting of, antibody fragments or variants thereof), that prevent the ability of NogoR to transduce a signal within a nerve cell. In one embodiment, an antibody that prevents the ability of NogoR to transduce a signal within a nerve cell comprises, or alternatively consists of, a VH and/or a VL domain of at least one of the scFvs referred to in Table 1, or a fragment or variant thereof. In a specific embodiment, an antibody that prevents the ability of NogoR to transduce a signal within a nerve cell comprises, or alternatively consists of, a VH and a VL domain of any one of the scFvs referred to in Table 1, or a fragment or variant thereof. Nucleic acid molecules encoding these antibodies are also encompassed by the invention.

The present invention also provides for antibodies (including molecules comprising, or alternatively consisting of, antibody fragments or variants thereof), that inhibit the collapse of neurite or axonal outgrowth of a neuron. In one embodiment, an antibody that inhibits the collapse of neurite or axonal outgrowth of a neuron comprises, or alternatively consists of, a VH and/or a VL domain of at least one of the scFvs referred to in Table 1, or a fragment or variant thereof. In a specific embodiment, an antibody that inhibits the collapse of neurite or axonal outgrowth of a neuron comprises, or alternatively consists of, a VH and a VL domain of any one of the scFvs referred to in Table 1, or a fragment or variant thereof. Nucleic acid molecules encoding these antibodies are also encompassed by the invention.

The present invention also provides for antibodies (including molecules comprising, or alternatively consisting of, antibody fragments or variants thereof), that induce apoptotic cell death in the CNS. In one embodiment, an antibody that induces apoptotic cell death comprises, or alternatively consists of a VH and/or a VL domain of at least one of the scFvs referred to in Table 1, or a fragment or variant thereof. In a specific embodiment, an antibody that induces apoptotic cell death comprises, or alternatively consists of a VH and a VL domain of any one of the scFvs referred to in Table 1, or a fragment or variant thereof. Nucleic acid molecules encoding these antibodies are also encompassed by the invention.

The present invention also provides for antibodies (including molecules comprising, or alternatively consisting of, antibody fragments or variants thereof) that stimulate the biological activities of NogoR. In one embodiment, an antibody that stimulates the biological activities of NogoR comprises, or alternatively consists of a VH and/or a VL domain of at least one of the scFvs referred to in Table 1, respectively, or a fragment or variant thereof. In a specific embodiment, an antibody that promotes the biological activities of NogoR comprises, or alternatively consists of, a VH and a VL domain of any one of the scFvs referred to in Table 1, respectively, or a fragment or variant thereof. Nucleic acid molecules encoding these antibodies are also encompassed by the invention.

The present invention also provides for fusion proteins comprising, or alternatively consisting of, an antibody (including molecules comprising, or alternatively consisting of, antibody fragments or variants thereof), that specifically bind to NogoR fused to a heterologous polypeptide. Preferably, the heterologous polypeptide to which the antibody is fused is useful for function or is useful to target the fusion protein to cells with surface bound NogoR molecules. In specific embodiments, the invention encompasses bispecific antibodies in which one antibody binding site is specific for NogoR and the second antibody binding site is specific for a heterologous polypeptide. In one embodiment, a fusion protein of the invention comprises, or alternatively consists of, a polypeptide having the amino acid sequence of any one or more of the VH domains of an antibody of the invention or the amino acid sequence of any one or more of the VL domains of an antibody of the invention or fragments or variants thereof, and a heterologous polypeptide sequence. In another embodiment, a fusion protein of the present invention comprises, or alternatively consists of, a polypeptide having the amino acid sequence of any one, two, three, or more of the VH CDRs of an antibody of the invention, or the amino acid sequence of any one, two, three, or more of the VL CDRs of an antibody of the invention, or fragments or variants thereof, and a heterologous polypeptide sequence. In a preferred embodiment, the fusion protein comprises, or alternatively consists of, a polypeptide having the amino acid sequence of, a VH CDR3 of an antibody of the invention, or fragment or variant thereof, and a heterologous polypeptide sequence, which fusion protein specifically binds to NogoR. In another embodiment, a fusion protein comprises, or alternatively consists of a polypeptide having the amino acid sequence of at least one VH domain of an antibody of the invention and the amino acid sequence of at least one VL domain of an antibody of the invention or fragments or variants thereof, and a heterologous polypeptide sequence. Preferably, the VH and VL domains of the fusion protein correspond to a single antibody (or scFv or Fab fragment) of the invention. In yet another embodiment, a fusion protein of the invention comprises, or alternatively consists of a polypeptide having the amino acid sequence of any one, two, three or more of the VH CDRs of an antibody of the invention and the amino acid sequence of any one, two, three or more of the VL CDRs of an antibody of the invention, or fragments or variants thereof, and a heterologous polypeptide sequence. Preferably, two, three, four, five, six, or more of the VHCDR(s) or VLCDR(s) correspond to single antibody (or scFv or Fab fragment) of the invention. Nucleic acid molecules encoding these fusion proteins are also encompassed by the invention.

Antibodies of the present invention (including antibody fragments or variants thereof) may be characterized in a variety of ways. In particular, antibodies and related molecules of the invention may be assayed for the ability to specifically bind to NogoR or fragments or variants thereof, using techniques described herein or routinely modifying techniques known in the art. Assays for the ability of the antibodies of the invention to specifically bind NogoR or a fragment or variant of NogoR, may be performed in solution (e.g., Houghten, *BioTechniques* 13:412-421(1992)), on beads (e.g., Lam, *Nature* 354:82-84 (1991)), on chips (e.g., Fodor, *Nature* 364: 555-556 (1993)), on bacteria (e.g., U.S. Pat. No. 5,223,409), on spores (e.g., U.S. Pat. Nos. 5,571,698; 5,403,484; and 5,223,409), on plasmids (e.g., Cull et al., *Proc Natl Acad Sci USA* 89:1865-1869 (1992)) or on phage (e.g., Scott and Smith, *Science* 249:386-390 (1990); Devlin, *Science* 249: 404-406 (1990); Cwirla et al., *Proc Natl Acad Sci USA* 87:7178-7182 (1990); and Felici, *J Mol Biol* 222:301-310 (1991)) (each of these references is incorporated herein in its entirety by reference). Antibodies that have been identified to specifically bind to NogoR or fragments or variants thereof can then be assayed for their specificity and affinity for NogoR, using or routinely modifying techniques described herein or otherwise known in the art (see, e.g., Example 1).

The antibodies of the invention may be assayed for specific binding to the NogoR polypeptide and cross-reactivity with other antigens by any method known in the art (See, for example, Examples 3-5). Immunoassays which can be used to analyze specific binding and cross-reactivity include, but are not limited to, competitive and non-competitive assay systems using techniques such as BIACORE™ analysis, FACS (fluorescence activated cell sorter) analysis, immunofluorescence, immunocytochemistry, radioimmunoassays, ELISA (enzyme linked immunosorbent assay), "sandwich" immunoassays, immunoprecipitation assays, Western blots, precipitin reactions, gel diffusion precipitin reactions, immunodiffusion assays, agglutination assays, complement-fixation assays, immunoradiometric assays, fluorescent immunoassays, and protein A immunoassays, to name but a few. Such assays are routine and well known in the art (see, e.g., Ausubel et al., eds, 1994, Current Protocols in Molecular Biology, Vol. 1, John Wiley & Sons, Inc., New York, which is incorporated by reference herein in its entirety). Exemplary immunoassays are described briefly below (but are not intended by way of limitation).

ELISAs comprise preparing antigen, coating the well of a 96-well microtiter plate with the antigen, washing away antigen that did not bind the wells, adding the antibody of interest conjugated to a detectable compound such as an enzymatic substrate (e.g., horseradish peroxidase or alkaline phosphatase) to the wells and incubating for a period of time, washing away unbound antibodies or non-specifically bound antibodies, and detecting the presence of the antibodies specifically bound to the antigen coating the well. In ELISAs, the antibody of interest does not have to be conjugated to a detectable compound; instead, a second antibody (which recognizes the antibody of interest) conjugated to a detectable compound may be added to the well. Alternatively, the antigen need not be directly coated to the well; instead the ELISA plates may be coated with an anti-Ig Fc antibody, and the antigen in the form of a NogoR-Fc fusion protein, may be bound to the anti-Ig Fc coated to the plate. This may be desirable so as to maintain the antigen protein (e.g., NogoR) in a more native conformation than it may have when it is directly coated to a plate. In another alternative, instead of coating the well with the antigen, the antibody may be coated to the well. In this case, the detectable molecule could be the antigen conjugated to a detectable compound such as an enzymatic substrate (e.g., horseradish peroxidase or alkaline phosphatase). One of skill in the art would be knowledgeable as to the parameters that can be modified to increase the signal detected as well as other variations of ELISAs known in the art. For further discussion regarding ELISAs, see, e.g., Ausubel et al., eds, 1994, Current Protocols in Molecular Biology, Vol. 1, John Wiley & Sons, Inc., New York at 11.2.1.

The binding affinity of an antibody (including an scFv or other molecule comprising, or alternatively consisting of, antibody fragments or variants thereof) to an antigen and the off-rate of an antibody-antigen interaction can be determined by competitive binding assays. One example of a competitive binding assay is a radioimmunoassay comprising the incubation of labeled antigen (e.g., antigen labeled with $^3$H or $^{125}$I), or fragment or variant thereof with the antibody of interest in the presence of increasing amounts of unlabeled antigen, and the detection of the antibody bound to the labeled antigen. The affinity of the antibody of the present invention for NogoR and the binding off-rates can be determined from the data by Scatchard plot analysis. Competition with a second antibody can also be determined using radioimmunoassays. In this case, NogoR is incubated with an antibody of the present invention conjugated to a labeled compound (e.g., compound labeled with $^3$H or $^{125}$I in the presence of increasing amounts of an unlabeled second anti-NogoR antibody. This kind of competitive assay between two antibodies, may also be used to determine if two antibodies bind the same or different epitopes.

In a preferred embodiment, BIACORE™ kinetic analysis is used to determine the binding on and off rates of antibodies (including antibody fragments or variants thereof) to NogoR, or fragments or variants thereof.

Immunoprecipitation protocols generally comprise lysing a population of cells in a lysis buffer such as RIPA buffer (1% NP-40 or Triton X-100, 1% sodium deoxycholate, 0.1% SDS, 0.15 M NaCl, 0.01 M sodium phosphate at pH 7.2, 1% Trasylol) supplemented with protein phosphatase and/or protease inhibitors (e.g., EDTA, PMSF, aprotinin, sodium vanadate), adding the antibody of interest to the cell lysate, incubating for a period of time (e.g., 1 to 4 hours) at 40° C., adding protein A and/or protein G sepharose beads to the cell lysate, incubating for about an hour or more at 40° C., washing the beads in lysis buffer and resuspending the beads in SDS/sample buffer. The ability of the antibody of interest to immunoprecipitate a particular antigen can be assessed by, e.g., Western blot analysis. One of skill in the art would be knowledgeable as to the parameters that can be modified to increase the binding of the antibody to an antigen and decrease the background (e.g., pre-clearing the cell lysate with sepharose beads). For further discussion regarding immunoprecipitation protocols see, e.g., Ausubel et al., eds, 1994, Current Protocols in Molecular Biology, Vol. 1, John Wiley & Sons, Inc., New York at 10.16.1.

Western blot analysis generally comprises preparing protein samples, electrophoresis of the protein samples in a polyacrylamide gel (e.g., 8%-20% SDS-PAGE depending on the molecular weight of the antigen), transferring the protein sample from the polyacrylamide gel to a membrane such as nitrocellulose, PVDF or nylon, blocking the membrane in blocking solution (e.g., PBS with 3% BSA or non-fat milk), washing the membrane in washing buffer (e.g., PBS-Tween 20), blocking the membrane with primary antibody (the antibody of interest) diluted in blocking buffer, washing the membrane in washing buffer, blocking the membrane with a secondary antibody (which recognizes the primary antibody, e.g., an anti-human antibody) conjugated to an enzymatic substrate (e.g., horseradish peroxidase or alkaline phosphatase) or radioactive molecule (e.g., $^{32}$P or $^{125}$I) diluted in blocking buffer, washing the membrane in wash buffer, and detecting the presence of the antigen. One of skill in the art would be knowledgeable as to the parameters that can be modified to increase the signal detected and to reduce the background noise. For further discussion regarding western blot protocols see, e.g., Ausubel et al., eds, 1994, Current Protocols in Molecular Biology, Vol. 1, John Wiley & Sons, Inc., New York at 10.8.1.

Antibody Conjugates

The present invention encompasses antibodies (including antibody fragments or variants thereof), recombinantly fused or chemically conjugated (including both covalent and non-covalent conjugations) to a heterologous polypeptide (or portion thereof, preferably at least 10, at least 20, at least 30, at least 40, at least 50, at least 60, at least 70, at least 80, at least 90 or at least 100 amino acids of the polypeptide) to generate fusion proteins. The fusion does not necessarily need to be direct, but may occur through linker sequences. For example, antibodies of the invention may be used to target heterologous polypeptides to particular cell types (e.g., cancer cells), either in vitro or in vivo, by fusing or conjugating the heterologous polypeptides to antibodies of the invention that are specific for particular cell surface antigens or which bind antigens that bind particular cell surface receptors. Antibodies of the invention may also be fused to albumin (including but not limited to recombinant human serum albumin (see, e.g., U.S. Pat. No. 5,876,969, issued Mar. 2, 1999, EP Patent 0 413 622, and U.S. Pat. No. 5,766,883, issued Jun. 16, 1998, herein incorporated by reference in their entirety)), resulting in chimeric polypeptides. In a preferred embodiment, polypeptides and/or antibodies of the present invention (including fragments or variants thereof) are fused with the mature form of human serum albumin (i.e., amino acids 1-585 of human serum albumin as shown in FIGS. 1 and 2 of EP Patent 0 322 094) which is herein incorporated by reference in its entirety. In another preferred embodiment, polypeptides and/or antibodies of the present invention (including fragments or variants thereof) are fused with polypeptide fragments comprising, or alternatively consisting of, amino acid residues 1-z of human serum albumin, where z is an integer from 369 to 419, as described in U.S. Pat. No. 5,766,883 herein incorporated by reference in its entirety. Polypeptides and/or antibodies of the present invention (including fragments or variants thereof) may be fused to either the N- or C-terminal end of the heterologous protein (e.g., immunoglobulin Fc polypeptide or human serum albumin polypeptide). Polynucleotides encoding fusion proteins of the invention are also encompassed by the invention. Such fusion proteins may, for example, facilitate purification and may increase half-life in vivo. Antibodies fused or conjugated to heterologous polypeptides may also be used in in vitro immunoassays and purification methods using methods known in the art. See e.g., Harbor et al., supra, and PCT publication WO 93/21232; EP 439,095; Naramura et al., *Immunol Lett* 39:91-99 (1994); U.S. Pat. No. 5,474,981; Gillies et al., *Proc Natl Acad Sci USA* 89:1428-1432 (1992); Fell et al., *J Immunol* 146:2446-2452 (1991), which are incorporated by reference in their entireties.

The present invention further includes compositions comprising, or alternatively consisting of, heterologous polypeptides fused or conjugated to antibody fragments. For example, the heterologous polypeptides may be fused or conjugated to a Fab fragment, Fd fragment, Fv fragment, F(ab)$_2$ fragment, or a portion thereof. Methods for fusing or conjugating polypeptides to antibody portions are known in the art. See, e.g., U.S. Pat. Nos. 5,356,603; 5,622,929; 5,359,046; 5,349,053; 5,447,851; 5,112,946; EP 307,434; EP 367,166; PCT publications WO 96/04388; WO 91/06570; Ashkenazi et al., *Proc Natl Acad Sci USA* 88:10535-10539 (1991); Zheng et al., *J Immunol* 154:5590-5600 (1995); and Vil et al., *Proc Natl Acad Sci USA* 89:11357-11341 (1992) (said references incorporated by reference in their entireties).

Additional fusion proteins of the invention may be generated through the techniques of gene-shuffling, motif-shuffling, exon-shuffling, and/or codon-shuffling (collectively referred to as "DNA shuffling"). DNA shuffling may be employed to modulate the activities of antibodies (including molecules comprising, or alternatively consisting of, antibody fragments or variants thereof), such methods can be used to generate antibodies with altered activity (e.g., antibodies with higher affinities and lower dissociation rates). See, generally, U.S. Pat. Nos. 5,605,793; 5,811,238; 5,830,721; 5,834,252; and 5,837,458, and Patten et al., *Curr Opinion Biotechnol* 8:724-35 (1997); Harayama, *Trends Biotechnol* 16(2):76-82 (1998); Hansson et al., *J Mol Biol* 287:265-76 (1999); and Lorenzo and Blasco, *Biotechniques* 24(2):308-13 (1998) (each of these patents and publications are hereby incorporated by reference in its entirety). In one embodiment, polynucleotides encoding antibodies of the invention may be altered by being subjected to random mutagenesis by error-prone PCR, random nucleotide insertion or other methods prior to recombination. In another embodiment, one or more portions of a polynucleotide encoding an antibody which portions specifically bind to NogoR may be recombined with one or more components, motifs, sections, parts, domains, fragments, etc. of one or more heterologous molecules.

Moreover, the antibodies of the present invention (including antibody fragments or variants thereof), can be fused to marker sequences, such as a polypeptides to facilitate purification. In preferred embodiments, the marker amino acid sequence is a hexa-histidine polypeptide, such as the tag provided in a pQE vector (QIAGEN Inc., Chatsworth, Calif.), among others, many of which are commercially available. As described in Gentz et al., *Proc Natl Acad Sci USA* 86:821-824 (1989), for instance, hexa-histidine provides for convenient purification of the fusion protein. Other peptide tags useful for purification include, but are not limited to, the hemagglutinin "HA" tag, which corresponds to an epitope derived from the influenza hemagglutinin protein (Wilson et al., *Cell* 37:767 (1984)) and the FLAG™ tag (STRATAGENE™, La Jolla, Calif.).

The present invention further encompasses antibodies (including antibody fragments or variants thereof), conjugated to a diagnostic or therapeutic agent. The antibodies can be used, for example, as part of a clinical testing procedure to, e.g., determine the safety and/or efficacy of a given treatment regimen. Detection can be facilitated by coupling the antibody to a detectable substance. Examples of detectable substances include, but are not limited to, various enzymes, prosthetic groups, fluorescent materials, luminescent materials, bioluminescent materials, radioactive materials, positron emitting metals using various positron emission tomographies, and nonradioactive paramagnetic metal ions. The detectable substance may be coupled or conjugated either directly to the antibody or indirectly, through an intermediate (such as, for example, a linker known in the art) using techniques known in the art. See, for example, U.S. Pat. No. 4,741,900 for metal ions which can be conjugated to antibodies for use as diagnostics according to the present invention. Examples of suitable enzymes include, but are not limited to, horseradish peroxidase, alkaline phosphatase, beta-galactosidase, or acetylcholinesterase; examples of suitable prosthetic group complexes include, but are not limited to, streptavidin/biotin and avidin/biotin; examples of suitable fluorescent materials include, but are not limited to, umbelliferone, fluorescein, fluorescein isothiocyanate, rhodamine, dichlorotriazinylamine fluorescein, dansyl chloride or phycoerythrin; an example of a luminescent material includes, but is not limited to, luminol; examples of bioluminescent materials include, but are not limited to, luciferase, luciferin, and aequorin; and examples of suitable radioactive material include, but are not limited to, iodine ($^{121}$I, $^{123}$I, $^{125}$I, $^{131}$I), carbon ($^{14}$C), sulfur ($^{35}$S), tritium ($^{3}$H), indium ($^{111}$In, $^{112}$In, $^{113m}$In, $^{115m}$In), technetium ($^{99}$Tc, $^{99m}$Tc), thallium ($^{201}$Ti), gallium ($^{68}$Ga, $^{67}$Ga), palladium ($^{103}$Pd), molybdenum ($^{99}$Mo), xenon ($^{135}$Xe), fluorine ($^{18}$F), $^{153}$Sm, $^{177}$Lu, $^{159}$Gd, $^{149}$Pm, $^{140}$La, $^{175}$Yb, $^{166}$Ho, $^{90}$Y, $^{47}$Sc, $^{186}$Re, $^{188}$Re, $^{142}$Pr, $^{105}$Rh, and $^{97}$Ru.

Further, an antibody of the invention (including an scFv or other molecule comprising, or alternatively consisting of, antibody fragments or variants thereof), may be coupled or conjugated to a therapeutic moiety such as a cytotoxin, e.g., a cytostatic or cytocidal agent, a therapeutic agent or a radioactive metal ion, e.g., alpha-emitters such as, for example, $^{213}$Bi, or other radioisotopes such as, for example, $^{103}$Pd, $^{135}$Xe, $^{131}$I, $^{68}$Ge, $^{57}$Co, $^{65}$Zn, $^{85}$Sr, $^{32}$P, $^{35}$S, $^{90}$Y, $^{153}$Sm, $^{153}$Gd, $^{169}$Yb, $^{51}$Cr, $^{54}$Mn, $^{75}$Se, $^{113}$Sn, $^{90}$Y, $^{117}$Tin, $^{186}$Re, $^{188}$Re and $^{166}$Ho. In specific embodiments, an antibody or fragment thereof is attached to macrocyclic chelators that chelate radiometal ions, including but not limited to, $^{177}$Lu, $^{90}$Y, $^{166}$Ho, and $^{153}$Sm, to polypeptides. In specific embodiments, the macrocyclic chelator is 1,4,7,10-tetraazacyclododecane-N,N',N'',N'''-tetraacetic acid (DOTA). In other specific embodiments, the DOTA is attached to the an antibody of the invention or fragment thereof via a linker molecule. Examples of linker molecules useful for conjugating DOTA to a polypeptide are commonly known in the art—see, for example, DeNardo et al., *Clin Cancer Res* 4(10):2483-90, 1998; Peterson et al., *Bioconjug Chem* 10(4):553-7, 1999; and Zimmerman et al., *Nucl Med Biol* 26(8):943-50, 1999 which are hereby incorporated by reference in their entirety.

A cytotoxin or cytotoxic agent includes any agent that is detrimental to cells and includes such molecules as small molecule toxins and enzymatically active toxins of bacterial, fungal, plant, or animal origin, or fragments thereof.

Examples include, but are not limited to, paclitaxol, cytochalasin B, gramicidin D, ethidium bromide, emetine, mitomycin, etoposide (VP-16), tenoposide, vincristine, vinblastine, colchicin, doxorubicin, daunorubicin, dihydroxy anthracin dione, mitoxantrone, mithramycin, actinomycin D, 1-dehydrotestosterone, glucocorticoids, procaine, tetracaine, lidocaine, propranolol, thymidine kinase, endonuclease, RNAse, and puromycin and fragments, variants or homologs thereof. Therapeutic agents include, but are not limited to, antimetabolites (e.g., methotrexate, 6-mercaptopurine, 6-thioguanine, cytarabine, 5-fluorouracil decarbazine), alkylating agents (e.g., mechlorethamine, thioepa chlorambucil, melphalan, carmustine (BSNU) and lomustine (CCNU), cyclophosphamide, busulfan, dibromomannitol, streptozotocin, mitomycin C, and cisdichlorodiamine platinum (II) (DDP) cisplatin), anthracyclines (e.g., daunorubicin (formerly daunomycin) and doxorubicin), antibiotics (e.g., dactinomycin (formerly actinomycin), bleomycin, mithramycin, and anthramycin (AMC)), and anti-mitotic agents (e.g., vincristine and vinblastine).

Additional examples of cytotoxins or cytotoxoc agents include, but are not limited to, improsulfan, piposulfan, benzodopa, carboquone, meturedopa, uredopa, altretamine, triethylenemelamine, trietylenephosphoramide, triethylenethio-phosphaoramide trimethylolomelamine, chlomraphazine, cholophosphamide, estramustine, ifosfamide, novembichin, phenesterine, prednimustine, trofosfamide, uracil mustard, chlorozotocin, fotemustine, nimustine, ranimustine, aclacinomysins, azaserine, cactinomycin, calicheamicin, carabicin, carminomycin, carzinophilin, chromomycins, detorubicin, 6-diazo-5-oxo-L-norleucine, epirubicin, esorubicin, idarubicin, marcellomycin, mycophenolic acid, nogalamycin, olivomycins, peplomycin, potfiromycin, quelamycin, rodorubicin, streptonigrin, tubercidin, ubenimex, zinostatin, zorubicin, denopterin, pteropterin, trimetrexate, fludarabine, thiamiprine, ancitabine, azacitidine, 6-azauridine, carmofur, dideoxyuridine, doxifluridine, enocitabine, floxuridine, 5-FU, calusterone, dromostanolone propionate, epitiostanol, mepitiostane, testolactone, aminoglutethimide, mitotane, trilostane, frolinic acid, aceglatone, aldophosphamide glycoside, aminolevulinic acid, amsacrine, bestrabucil, bisantrene, edatraxate, defofamine, demecolcine, diaziquone, elfomithine, elliptinium acetate, etoglucid, gallium nitrate, hydroxyurea, lentinan, lonidamine, mitoguazone, mopidamol, nitracrine, pentostatin, phenamet, pirarubicin, podophyllinic acid, 2-ethylhydrazide, procarbazine, PSKO, razoxane, sizofiran, spirogenmanium, tenuazonic acid, triaziquone, 2,2',2"-trichlorotriethylamine, urethan, vindesine, dacarbazine, mannomustine, mitobronitol, mitolactol, pipobroman, gacytosine, arabinoside ("Ara-C"), taxoids, e.g. paclitaxel ("TAXOL™", BRISTOL-MYERS SQUIBB ONCOLOGY™, Princeton, N.J.) doxetaxel ("TAXOTERE™", RHONE-POULENC RORER™, Antony, France), gemcitabine, ifosfamide, vinorelbine, navelbine, novantrone, teniposide, aminopterin, xeloda, ibandronate, CPT-I 1, topoisomerase inhibitor RFS 2000, difluoromethylomithine (DMFO), retinoic acid, esperamicins, capecitabine, and pharmaceutically acceptable salts, acids or derivatives of any of the above. Also included in this definition are anti-hormonal agents that act to regulate or inhibit hormone action on tumors such as anti-estrogens including for example tamoxifen, raloxifene, aromatase inhibiting 4(5)imidazoles, 4 hydroxytamoxifen, trioxifene, keoxifene, LY 117018, onapristone, toremifene (FARESTON™), and anti-androgens such as flutamide, nilutamide, bicalutamide, leuprolide, and goserelin, and pharmaceutically acceptable salts, acids or derivatives of any of the above.

Techniques known in the art may be applied to label antibodies of the invention. Such techniques include, but are not limited to, the use of bifunctional conjugating agents (see e.g., U.S. Pat. Nos. 5,756,065; 5,714,711; 5,696,239; 5,652,371; 5,505,931; 5,489,425; 5,435,990; 5,428,139; 5,342,604; 5,274,119; 4,994,560; and 5,808,003; the contents of each of which are hereby incorporated by reference in its entirety) and direct coupling reactions (e.g., Bolton-Hunter and Chloramine-T reaction).

The antibodies of the invention which are conjugates can be used for modifying a given biological response, the therapeutic agent or drug moiety is not to be construed as limited to classical chemical therapeutic agents. For example, the drug moiety may be a protein or polypeptide possessing a desired biological activity. Such proteins may include, but are not limited to, for example, a toxin such as abrin, ricin A, alpha toxin, pseudomonas exotoxin, or diphtheria toxin, saporin, momordin, gelonin, pokeweed antiviral protein, alpha-sarcin and cholera toxin; a protein such as tumor necrosis factor, alpha-interferon, beta-interferon, nerve growth factor, platelet derived growth factor, tissue plasminogen activator, an apoptotic agent, e.g., TNF-alpha, TNF-beta, AIM I (see, International Publication No. WO 97/35899), AIM II (see, International Publication No. WO 97/34911), Fas Ligand (Takahashi et al., Int Immunol 6:1567-1574 (1994)), VEGI (see, International Publication No. WO 99/23105), a thrombotic agent or an anti-angiogenic agent, e.g., angiostatin or endostatin; or, biological response modifiers such as, for example, lymphokines, interleukin-1 (IL-1), interleukin-2 (IL-2), interleukin-6 (IL-6), granulocyte macrophage colony stimulating factor (GM-CSF), granulocyte colony stimulating factor (G-CSF), or other growth factors.

In specific embodiments, antibodies of the invention are conjugated or fused to a polypeptide cytotoxin. An example of a suitable polypeptide cytotoxin is a ribosome-inactivating protein. Type I ribosome-inactivating proteins are single-chain proteins, while type II ribosome-inactivating proteins consist of two nonidentical subunits (A and B chains) joined by a disulfide bond (for a review, see Soria et al., *Targeted Diagn Ther* 7:193-212 (1992)). In one embodiment, type I ribosome-inactivating proteins that may be used include, but are not limited to, polypeptides from *Saponaria officinalis* (e.g., saporin-1, saporin-2, saporin-3, saporin-6), *Momordica charantia* (e.g., momordin), *Byronia dioica* (e.g., bryodin, bryodin-2), *Trichosanthes kirilowii* (e.g., trichosanthin, trichokirin), *Gelonium multiflorum* (e.g., gelonin), *Phytolacca americana* (e.g., pokeweed antiviral protein, pokeweed antiviral protein-II, pokeweed antiviral protein-S), and *Phytolacca dodecandra* (e.g., dodecandrin, Mirabilis antiviral protein). Ribosome-inactivating proteins are described, for example, by Walsh et al., U.S. Pat. No. 5,635,384. In specific embodiments, an antibody of the invention is conjugated or fused to a fragment or variant of the ribosome inactivating proteins described above, particularly when said fragment or variant retains activity.

In another embodiment, type II ribosome-inactivating proteins that may be used according to the invention include, but are not limited to, polypeptides from *Ricinus communis* (e.g., ricin), *Abrus precatorius* (e.g., abrin), and *Adenia digitata* (e.g., modeccin). Since type II ribosome-inactivating proteins include a B chain that binds galactosides and a toxic A chain that depurinates adensoine, type II ribosome-inactivating protein conjugates should include the A chain. Additional ribosome-inactivating proteins that may be used according to the invention include, but are not limited to, bouganin, clavin, maize ribosome-inactivating proteins, *Vaccaria pyramidata* ribosome-inactivating proteins, nigrine b, basic nigrine 1, ebuline, racemosine b, luffin-a, luffin-b, luffin-S, and other ribosome-inactivating proteins known to those of skill in the art. See, for example, Bolognesi and Stirpe, International Publication No. WO98/55623, Colnaghi et al., International Publication No. WO97/49726, Hey et al., U.S. Pat. No. 5,635,384, Bolognesi and Stirpe, International Publication No. WO95/07297, Arias et al., International Publication No. WO94/20540, Watanabe et al., *J Biochem* 106:6 977 (1989); Islam et al., Agric *Biol Chem* 55:229 (1991), and Gao et al., *FEBS Lett* 347:257 (1994). In specific embodiments, an antibody of the invention is conjugated or fused to a fragment or variant of the ribosome inactivating proteins described above, particularly when said fragment or variant retains activity.

Additional ribosome inactivating proteins (RIPs) that may be conjugated or fused to antibodies of the invention include, but are not limited to, Type I Plant RIPs such as Pokeweed antiviral proteins, Tritin, Gelonin, Momordin, Saporin, Dianthin, and Maize RIP; Type II Plant RIPs such as Ricin, Abrin, Modecin, Viscumin, Volkensin, Cinnamomin, Mistletoe lectin I and Luffangulin (6 kda); Bacterial RIPS such as Shiga toxin, and Shiga-like toxin; and Fungal RIPS such as alpha-sarcin, mitogillin, and restrictocin. In specific embodiments, an antibody of the invention is conjugated or fused to a fragment or variant of the ribosome inactivating proteins described above, particularly when said fragment or variant retains activity.

Ricin A homologues that may be conjugated or fused to antibodies of the invention include, but are not limited to, polypeptides that have the same amino acid sequence as a protein selected from the group consisting of: type 2 ribosome-inactivating protein cinnamomin III precursor, abrin-d precursor from Indian licorice or fragment thereof, RIP precursor of *Sambucus nigra,* RIP bryodin II precursor, alpha-trichosanthin, ribosome-inactivating protein precursor from *Sambucus ebulus,* karasurin-B, Trichobakin, Beta-Luffin, Beta-galactoside specific lectin I A chain (MLA; ML-I A), lectin chain A isoform 2 from *Viscum album* subsp. *coloratum,* curcin precursor from *Jatropha curcas,* trichoanguina from snake gourd, ribosome-inactivating protein IRAb from *Iris hollandica,* Momordin, trichoanguin from *Trichosanthes cucumerina,* momordin II from *Momordica balsamina,* gelonin from *Gelonium multiflorum,* ribosome inactivating protein RIPm from *Polygonatum multiflorum,* ribosome inactivating protein Euserratin 2 precursor from *Euphorbia serrata,* alpha-PAP (pokeweed antiviral protein) from *Phytolacca americana,* ribosome-inactivating protein gynostemmin II from *Gynostemma pentaphyllum,* trichosanthin, ribosome-inactivating protein 2 from *Phytolacca insularis,* bouganin from *Bougainvillea spectabilis,* antiviral protein from *Clerodendrum aculeatum,* anti-viral protein PAP from *Phytolacca acinosa,* type I RIP moschatin I, antiviral ribosome inactivating protein from *Chenopodium album,* Beta-vulgin from *Beta vulgaris* subsp. *vulgaris,* ribosome-inactivating protein benincasin from *Benincasa hispida,* ribosome-inactivating protein ME1 from *Mirabilis expansa,* MAP—MIRABILIS—Four-o'clock (Marvel-of-peru), RIP amaranthin, amarandin-S from *Amaranthus tricolor,* ribosome-inactivating protein from *Spinacia oleracea,* type I RIP musarmin 3 from *Muscari,* saporin from *Saponaria officinalis,* dianthin 30 from *Dianthus caryophyllus,* and tritin from *Triticum aestivum,* or fragments or variants thereof. Other toxins that may be conjugated or fused to antibodies of the invention include, but are not limited to diptheria toxin, *Pseudomonas* exotoxin A, Botulinum neurotoxin, *Clostridium perfringens* epsilon toxin, Conotoxins, and *Staphylococcal* enterotoxins.

Antibodies of the invention (including antibody fragments or variants thereof), may also be attached to solid supports, which are particularly useful for immunoassays or purification of the target antigen. Such solid supports include, but are not limited to, glass, cellulose, polyacrylamide, nylon, polystyrene, polyvinyl chloride or polypropylene.

Techniques for conjugating a therapeutic moiety to antibodies are well known, see, e.g., Amon et al., "Monoclonal Antibodies For Immunotargeting Of Drugs In Cancer Therapy", in Monoclonal Antibodies And Cancer Therapy, Reisfeld et al. (eds.), pp. 243-56 (Alan R. Liss, Inc. 1985); Hellstrom et al., "Antibodies For Drug Delivery", in Controlled Drug Delivery (2nd Ed.), Robinson et al. (eds.), pp. 623-53 (Marcel Dekker, Inc. 1987); Thorpe, "Antibody Carriers Of Cytotoxic Agents In Cancer Therapy: A Review", in Monoclonal Antibodies '84: Biological And Clinical Applications, Pinchera et al. (eds.), pp. 475-506 (1985); "Analysis, Results, And Future Prospective Of The Therapeutic Use Of Radiolabeled Antibody In Cancer Therapy", in Monoclonal Antibodies For Cancer Detection And Therapy, Baldwin et al. (eds.), pp. 303-16 (Academic Press 1985), and Thorpe et al., Immunol Rev 62:119-58 (1982).

Alternatively, an antibody of the invention can be conjugated to a second antibody to form an antibody heteroconjugate as described by Segal in U.S. Pat. No. 4,676,980, which is incorporated herein by reference in its entirety.

An antibody of the invention (including an other molecules comprising, or alternatively consisting of, an antibody fragment or variant thereof), with or without a therapeutic moiety conjugated to it, administered alone or in combination with cytotoxic factor(s) and/or cytokine(s) can be used as a therapeutic.

Uses of Antibodies of the Invention

Antibodies of the present invention may be used, for example, but not limited to, to purify, detect, and target the polypeptides of the present invention, including both in vitro and in vivo diagnostic and therapeutic methods. For example, the antibodies have use in immunoassays for qualitatively and quantitatively measuring levels of NogoR polypeptides in biological and non-biological samples. See, e.g., Harlow et al., Antibodies: A Laboratory Manual, (Cold Spring Harbor Laboratory Press, 2nd ed. 1988) (incorporated by reference herein in its entirety).

Therapeutic treatment to treat, for example, spinal cord injury, stroke, degenerative CNS disorders and paralysis with anti-NogoR antibodies has advantages over current treatments (some CNS disorders currently have no treatment options). Anti-NogoR antibodies can be given as either a single dose treatment or can be given in multiple doses (e.g., bi-weekly or monthly dosing). Individual doses of anti-NogoR antibodies will have a relatively long duration of effect. Given that the anti-NogoR antibodies provided herein may be fully human antibodies, the risk of side effects due to anti-NogoR treatment will be minimal when administered as fully human antibodies.

Immunophenotyping

The antibodies of the invention may be utilized for immunophenotyping of cell lines and biological samples. The translation product of the gene of the present invention may be useful as a cell specific marker, or more specifically as a cellular marker that is differentially expressed at various stages of differentiation and/or maturation of particular cell types, particularly of nerve cells. Monoclonal antibodies directed against a specific epitope, or combination of epitopes, will allow for the screening of cellular populations expressing the marker. Various techniques can be utilized using monoclonal antibodies to screen for cellular populations expressing the marker(s), and include magnetic separation using antibody-coated magnetic beads, "panning" with antibody attached to a solid matrix (i.e., plate), and flow cytometry (See, e.g., U.S. Pat. No. 5,985,660; and Morrison et al., *Cell* 96:737-49 (1999)).

These techniques allow for the screening of particular populations of cells, such as nerve cells or cancerous cells. Alternatively, these techniques allow for the screening of tissue samples for the expression of NogoR.

Epitope Mapping

The present invention provides antibodies (including antibody fragments or variants thereof), that can be used to identify epitopes of the NogoR polypeptide (SEQ ID NO:2) using techniques described herein or otherwise known in the art. Fragments which function as epitopes may be produced by any conventional means. (See, e.g., Houghten, *Proc Natl Acad Sci USA* 82:5131-5135 (1985), further described in U.S. Pat. No. 4,711,211.) Identified epitopes of antibodies of the present invention may, for example, be used as vaccine candidates, i.e., to immunize an individual to elicit antibodies against the naturally occurring form of NogoR.

Diagnostic Uses of Antibodies

Labeled antibodies of the invention (including molecules comprising, or alternatively consisting of, antibody fragments or variants thereof) which specifically bind to a NogoR polypeptide can be used for diagnostic purposes to detect, diagnose, prognose, or monitor diseases and/or disorders. In specific embodiments, labeled antibodies of the invention (including molecules comprising, or alternatively consisting of, antibody fragments or variants thereof) which specifically bind to a NogoR polypeptide can be used for diagnostic purposes to detect, diagnose, prognose, or monitor diseases and/or disorders associated with the aberrant expression and/or activity of a NogoR polypeptide.

The invention provides for the detection of expression of a NogoR polypeptide comprising: (a) assaying the expression of a NogoR polypeptide in a biological sample from an individual using one or more antibodies of the invention that specifically binds to a NogoR polypeptide; and (b) comparing the level of a NogoR polypeptide with a standard level of a NogoR polypeptide (e.g., the level in normal biological samples).

The invention provides for the detection of aberrant expression of a NogoR polypeptide comprising: (a) assaying the expression of a NogoR polypeptide in a biological sample from an individual using one or more antibodies of the invention that specifically binds to a NogoR polypeptide; and (b) comparing the level of a NogoR polypeptide with a standard level of a NogoR polypeptide, e.g., in normal biological samples, whereby an increase or decrease in the assayed level of a NogoR polypeptide compared to the standard level of a NogoR polypeptide is indicative of aberrant expression.

By "biological sample" is intended any fluids and/or cells obtained from an individual, body fluid, body tissue, body cell, cell line, tissue culture, or other source which may contain a NogoR polypeptide protein or mRNA. Body fluids include, but are not limited to, sera, plasma, urine, saliva, mucous, pleural fluid, synovial fluid, and spinal fluid. Tissues samples may be taken from virtually any tissue in the body. Tissue samples may also be obtained from autopsy material. Methods for obtaining tissue biopsies and body fluids from mammals are well known in the art. Where the biological sample is to include mRNA, a tissue biopsy is the preferred source.

One aspect of the invention is the detection and diagnosis of a disease or disorder associated with aberrant expression of a NogoR polypeptide or a NogoR polypeptide in an animal, preferably a mammal and most preferably a human. In one embodiment, diagnosis comprises: a) administering (for example, parenterally, subcutaneously, or intraperitoneally) to a subject an effective amount of a labeled antibody of the invention (including molecules comprising, or alternatively consisting of, antibody fragments or variants thereof) that specifically binds to a NogoR polypeptide; b) waiting for a time interval following the administering for permitting the labeled antibody to preferentially concentrate at sites in the subject where NogoR polypeptide is expressed (and for unbound labeled molecule to be cleared to background level); c) determining background level; and d) detecting the labeled antibody in the subject, such that detection of labeled antibody or fragment thereof above the background level and above or below the level observed in a person without the disease or disorder indicates that the subject has a particular disease or disorder associated with aberrant expression of a NogoR polypeptide or a NogoR polypeptide. Background level can be determined by various methods including, comparing the amount of labeled molecule detected to a standard value previously determined for a particular system.

It will be understood in the art that the size of the subject and the imaging system used will determine the quantity of imaging moiety needed to produce diagnostic images. In the case of a radioisotope moiety, for a human subject, the quantity of radioactivity injected will normally range from about 5 to 20 milliCuries of $^{99}$Tc. The labeled antibody will then preferentially accumulate at the location of cells which contain the specific protein. In vivo tumor imaging is described in S. W. Burchiel et al., "Immunopharmacokinetics of Radiolabeled Antibodies and Their Fragments." (Chapter 13 in Tumor Imaging: The Radiochemical Detection of Cancer, S. W. Burchiel and B. A. Rhodes, eds., Masson Publishing Inc. (1982).

Depending on several variables, including the type of label used and the mode of administration, the time interval following the administration for permitting the labeled molecule to preferentially concentrate at sites in the subject and for unbound labeled molecule to be cleared to background level is 6 to 48 hours or 6 to 24 hours or 6 to 12 hours. In another embodiment the time interval following administration is 5 to 20 days or 5 to 10 days.

In one embodiment, monitoring of the disease or disorder is carried out by repeating the method for diagnosing the disease or disorder, for example, one month after initial diagnosis, six months after initial diagnosis, one year after initial diagnosis, etc.

Presence of the labeled molecule can be detected in the patient using methods known in the art for in vivo scanning. These methods depend upon the type of label used. Skilled artisans will be able to determine the appropriate method for detecting a particular label. Methods and devices that may be used in the diagnostic methods of the invention include, but are not limited to, computed tomography (CT), whole body scan such as position emission tomography (PET), magnetic resonance imaging (MRI), and sonography.

In a specific embodiment, the molecule is labeled with a radioisotope and is detected in the patient using a radiation responsive surgical instrument (Thurston et al., U.S. Pat. No. 5,441,050). In another embodiment, the molecule is labeled with a fluorescent compound and is detected in the patient using a fluorescence responsive scanning instrument. In another embodiment, the molecule is labeled with a positron emitting metal and is detected in the patient using positron emission-tomography. In yet another embodiment, the molecule is labeled with a paramagnetic label and is detected in a patient using magnetic resonance imaging (MRI).

In specific embodiments, antibodies of the present invention may be used in the diagnosis, prevention, and treatment of neurological conditions and hyperproliferative diseases (e.g., cancers) and diseases and disorders, particularly those diseases and/or disorders described in the "Therapeutic Uses of Antibodies" sections below.

Therapeutic Uses of Antibodies

One or more antibodies of the present invention (including molecules comprising, or alternatively consisting of, antibody fragments or variants thereof) that specifically bind to NogoR may be used locally or systemically in the body as a therapeutic. The present invention is further directed to antibody-based therapies which involve administering antibodies of the invention (including molecules comprising, or alternatively consisting of, antibody fragments or variants thereof) to an animal, preferably a mammal, and most preferably a human, for treating or ameliorating individuals afflicted with nervous system disorders/diseases, such as spinal cord injury, brain trauma, paralysis, degenerative nervous system diseases, and stroke. Therapeutic compounds of the invention include, but are not limited to, antibodies of the invention and nucleic acids encoding antibodies of the invention as described herein.

In another embodiment, antibodies of the present invention (including molecules comprising, or alternatively consisting of, antibody fragments or variants thereof) that specifically bind to NogoR may be used to promote axon/neurite outgrowth, overcome myelin inhibition, prevent growth cone collapse, traverse a glial scar, prevent necrosis, promote neuronal regeneration, promote axonal regeneration, treat demyelination and/or prevent inflammation.

In another embodiment, antibodies of the present invention (including molecules comprising, or alternatively consisting of, antibody fragments or variants thereof) that specifically bind to NogoR may be used to treat neoplasias, such as cancers of the nervous system, and/or other non-nervous system cancers. Antibodies of the present invention may induce apoptotic cell death. Armed with the teachings provided herein, one of ordinary skill in the art will know how to use the antibodies of the present invention for therapeutic purposes without undue experimentation.

Antibodies of the invention may be provided in pharmaceutically acceptable compositions (as known in the art or as described herein).

Spinal Cord Injury

The spinal cord is a major bundle of nerves that carries nerve impulses between the brain and body. The spinal cord is protected by the vertebrae, which constitute the spinal column. The spinal cord extends from the base of the brain through the vertebrae of the spinal column. Thirty-one pairs of spinal nerves arise from the sides of the spinal cord and innervate muscle fibers, which in turn, elicit movement. External stimuli is transmitted from receptors on sensory neurons to interneurons, which are located within the spinal cord. Thus, the spinal cord conveys sensory information in the form of nerve impulses from sensory neurons to the brain and conveys motor information from the brain to various effectors, i.e., muscles and glands.

Spinal cord injury (SCI) is defined as any injury to the spinal cord that results in either a temporary or permanent change in normal motor, sensory, or autonomic function. There are two types of SCI—complete and incomplete. A complete injury is an injury where there is no function below the level of the injury, i.e., no sensation or voluntary movement. An incomplete injury results in the retention of some function below the primary level of the injury. A person with an incomplete injury may have partial motor and/or sensory function. SCI that result in loss of motor and/or sensory nerve function may range from damage to the spinal cord through to complete severence of the spinal cord.

Generally, the higher in the spinal column the injury occurs, the more dysfunction a person will experience. Cervical SCI's resulting from damage to the spinal column within the neck usually cause loss of function in the arms and legs, resulting in tetraplegia. Injuries in the thoracic region usually affect the chest and the legs and result in paraplegia, or complete paralysis of the lower half of the body. The vertebra in the lower back between the thoracic vertebra, where the ribs attach, and the pelvis (hip bone), are the lumbar vertebra. The sacral vertebra run from the pelvis to the end of the spinal column. Injuries to the lumbar vertebra and similarly to the sacral vertebra generally result in some loss of function in the hips and legs.

Destruction from direct trauma, compression by bone fragments or hematomas, and ischemia from damage or impingement on spinal arteries often lead to SCIs. The most common causes of SCI are motor vehicle accidents, falling (especially persons over the age of 45), violence, and sports injuries, particularly diving. Other causes include vascular disorders, tumors, infectious conditions, spondylosis (spinal osteoarthritis), and developmental disorders.

Antibodies of the present invention may be useful for the diagnosis and/or treatment of diseases, disorders, damage of injury to the spinal cord.

Neural Activity, Neurological Diseases, and Nervous System Diseases

Antibodies of the present invention may be useful for the diagnosis and/or treatment of diseases, disorders, damage or injury of the brain and/or nervous system. Nervous system disorders that can be treated with the anti-NogoR antibodies of the present invention include, but are not limited to, nervous system injuries, and diseases or disorders which result in either a disconnection of axons, a diminution or degeneration of neurons, or demyelination. Nervous system lesions which may be treated in a patient (including human and non-human mammalian patients) according to the methods of the invention, include but are not limited to, the following lesions of either the central (including spinal cord, brain) or peripheral nervous systems: (1) ischemic lesions, in which a lack of oxygen in a portion of the nervous system results in neuronal injury or death, including cerebral infarction or ischemia, or spinal cord infarction or ischemia; (2) traumatic lesions, including lesions caused by physical injury or associated with surgery, for example, lesions which sever a portion of the nervous system, or compression injuries; (3) malignant lesions, in which a portion of the nervous system is destroyed or injured by malignant tissue which is either a nervous system associated malignancy or a malignancy derived from non-nervous system tissue; (4) infectious lesions, in which a portion of the nervous system is destroyed or injured as a result of infection, for example, by an abscess or associated with infection by human immunodeficiency virus, herpes zoster, or herpes simplex virus or with Lyme disease, tuberculosis, or syphilis; (5) degenerative lesions, in which a portion of the nervous system is destroyed or injured as a result of a degenerative process including but not limited to, degeneration associated with Parkinson's disease, Alzheimer's disease, Huntington's chorea, or amyotrophic lateral sclerosis (ALS); (6) lesions associated with nutritional diseases or disorders, in which a portion of the nervous system is destroyed or injured by a nutritional disorder or disorder of metabolism including, but not limited to, vitamin B12 deficiency, folic acid deficiency, Wernicke disease, tobacco-alcohol amblyopia, Marchiafava-Bignami disease (primary degeneration of the corpus callosum), and alcoholic cerebellar degeneration; (7) neurological lesions associated with systemic diseases including, but not limited to, diabetes (diabetic neuropathy, Bell's palsy), systemic lupus erythematosus, carcinoma, or sarcoidosis; (8) lesions caused by toxic substances including alcohol, lead, or particular neurotoxins; and (9) demyelinated lesions in which a portion of the nervous system is destroyed or injured by a demyelinating disease including, but not limited to, multiple sclerosis, human immunodeficiency virus-associated myelopathy, transverse myelopathy or various etiologies, progressive multifocal leukoencephalopathy, and central pontine myelinolysis.

In one embodiment, the antibodies of the present invention are used to protect neural cells from the damaging effects of hypoxia. In a further preferred embodiment, the antibodies of the present invention are used to protect neural cells from the damaging effects of cerebral hypoxia. According to this embodiment, antibodies that specifically bind to NogoR or fragments thereof are used to treat or prevent neural cell injury associated with cerebral hypoxia. In one non-exclusive aspect of this embodiment, the present invention is used to treat or prevent neural cell injury associated with cerebral ischemia. In another non-exclusive aspect of this embodiment, anti-NogoR antibodies are used to treat or prevent neural cell injury associated with cerebral infarction.

In another preferred embodiment, antibodies of the invention are used to treat or prevent neural cell injury associated with a stroke. In a specific embodiment, antibodies of the invention are used to treat or prevent cerebral neural cell injury associated with a stroke.

In another preferred embodiment, antibodies of the invention are used to treat or prevent neural cell injury associated with a heart attack. In a specific embodiment, antibodies that specifically bind NogoR, or fragments thereof, are used to treat or prevent cerebral neural cell injury associated with a heart attack.

Antibodies of the invention which are useful for treating or preventing a nervous system disorder may be selected by testing for biological activity in promoting the survival or differentiation of neurons. For example, and not by way of limitation, compositions of the invention which elicit any of the following effects may be useful according to the invention: (1) increased survival time of neurons in culture either in the presence or absence of hypoxia or hypoxic conditions; (2) increased sprouting of neurons in culture or in vivo; (3) increased production of a neuron-associated molecule in culture or in vivo, e.g., choline acetyltransferase or acetylcholinesterase with respect to motor neurons; or (4) decreased symptoms of neuron dysfunction in vivo. Such effects may be measured by any method known in the art. In preferred, non-limiting embodiments, increased survival of neurons may routinely be measured using a method set forth herein or otherwise known in the art, such as, for example, in Zhang et al., *Proc Natl Acad Sci USA* 97:3637-42 (2000) or in Arakawa et al., *J Neurosci,* 10:3507-15 (1990); increased sprouting of neurons may be detected by methods known in the art, such as, for example, the methods set forth in Pestronk et al., *Exp Neurol,* 70:65-82 (1980), or Brown et al., *Ann Rev Neurosci,* 4:17-42 (1981); increased production of neuron-associated molecules may be measured by bioassay, enzymatic assay, antibody binding, Northern blot assay, etc., using techniques known in the art and depending on the molecule to be measured; and motor neuron dysfunction may be measured by assessing the physical manifestation of motor neuron disorder, e.g., weakness, motor neuron conduction velocity, or functional disability.

In specific embodiments, motor neuron disorders that may be treated according to the invention include, but are not limited to, disorders such as infarction, infection, exposure to toxin, trauma, surgical damage, degenerative disease or malignancy that may affect motor neurons as well as other components of the nervous system, as well as disorders that selectively affect neurons such as amyotrophic lateral sclerosis, and including, but not limited to, progressive spinal muscular atrophy, progressive bulbar palsy, primary lateral sclerosis, infantile and juvenile muscular atrophy, progressive bulbar paralysis of childhood (Fazio-Londe syndrome), poliomyelitis and the post polio syndrome, and Hereditary Motorsensory Neuropathy (Charcot-Marie-Tooth Disease).

Further, antiboides of the invention may affect neuronal survival; synapse formation; conductance; neural differentiation, etc. Thus, antibodies of the invention may be used to treat and/or ameliorate diseases or disorders associated with these roles, including, but not limited to, learning and/or cognition disorders. The anti-NogoR antibodies may also be useful in the treatment or prevention of neurodegenerative disease states and/or behavioural disorders. Such neurodegenerative disease states and/or behavioral disorders include, but are not limited to, Alzheimer's Disease, Parkinson's Disease, Huntington's Disease, Tourette Syndrome, schizophrenia, mania, dementia, paranoia, obsessive compulsive disorder, panic disorder, learning disabilities, ALS, psychoses, autism, and altered behaviors, including disorders in feeding, sleep patterns, balance, and perception. In addition, compositions of the invention may also be useful in the treatment, prevention and/or detection of developmental disorders associated with the developing embryo, or sexually-linked disorders.

Additionally, antibodies of the present invention may be useful in protecting neural cells from diseases, damage, disorders, or injury, associated with cerebrovascular disorders including, but not limited to, carotid artery diseases (e.g., carotid artery thrombosis, carotid stenosis, or Moyamoya Disease), cerebral amyloid angiopathy, cerebral aneurysm, cerebral anoxia, cerebral arteriosclerosis, cerebral arteriovenous malformations, cerebral artery diseases, cerebral embolism and thrombosis (e.g., carotid artery thrombosis, sinus thrombosis, or Wallenberg's Syndrome), cerebral hemorrhage (e.g., epidural or subdural hematoma, or subarachnoid hemorrhage), cerebral infarction, cerebral ischemia (e.g., transient cerebral ischemia, Subclavian Steal Syndrome, or vertebrobasilar insufficiency), vascular dementia (e.g., multi-infarct), leukomalacia, periventricular, and vascular headache (e.g., cluster headache or migraines).

In accordance with yet a further aspect of the present invention, there is provided a process for utilizing the antibodies of the present invention for therapeutic purposes, for example, to stimulate neurological cell proliferation and/or differentiation. Therefore, antibodies of the invention may be used to treat and/or detect neurologic diseases.

Examples of neurologic diseases which can be treated using antibodies of the present invention include brain diseases, such as metabolic brain diseases which includes phenylketonuria such as maternal phenylketonuria, pyruvate carboxylase deficiency, pyruvate dehydrogenase complex deficiency, Wernicke's Encephalopathy, brain edema, brain neoplasms such as cerebellar neoplasms which include infratentorial neoplasms, cerebral ventricle neoplasms such as choroid plexus neoplasms, hypothalamic neoplasms, supratentorial neoplasms, canavan disease, cerebellar diseases such as cerebellar ataxia which include spinocerebellar degeneration such as ataxia telangiectasia, cerebellar dyssynergia, Friederich's Ataxia, Machado-Joseph Disease, olivopontocerebellar atrophy, cerebellar neoplasms such as infratentorial neoplasms, diffuse cerebral sclerosis such as encephalitis periaxialis, globoid cell leukodystrophy, metachromatic leukodystrophy and subacute sclerosing panencephalitis.

Additional neurologic diseases which can be treated with antibodies of the present invention include cerebrovascular disorders (such as carotid artery diseases which include carotid artery thrombosis, carotid stenosis and Moyamoya Disease), cerebral amyloid angiopathy, cerebral aneurysm, cerebral anoxia, cerebral arteriosclerosis, cerebral arteriovenous malformations, cerebral artery diseases, cerebral embolism and thrombosis such as carotid artery thrombosis, sinus thrombosis and Wallenberg's Syndrome, cerebral hemorrhage such as epidural hematoma, subdural hematoma and subarachnoid hemorrhage, cerebral infarction, cerebral ischemia such as transient cerebral ischemia, Subclavian Steal Syndrome and vertebrobasilar insufficiency, vascular dementia such as multi-infarct dementia, periventricular leukomalacia, vascular headache such as cluster headache and migraine.

Additional neurologic diseases which can be treated with the present invention include dementia such as AIDS Dementia Complex, presenile dementia such as Alzheimer's Disease and Creutzfeldt-Jakob Syndrome, senile dementia such as Alzheimer's Disease and progressive supranuclear palsy, vascular dementia such as multi-infarct dementia, encephalitis which include encephalitis periaxialis, viral encephalitis such as epidemic encephalitis, Japanese Encephalitis, St. Louis Encephalitis, tick-borne encephalitis and West Nile Fever, acute disseminated encephalomyelitis, meningoencephalitis such as uveomeningoencephalitic syndrome, Postencephalitic Parkinson Disease and subacute sclerosing panencephalitis, encephalomalacia such as periventricular leukomalacia, epilepsy such as generalized epilepsy which includes infantile spasms, absence epilepsy, myoclonic epilepsy which includes MERRF Syndrome, tonic-clonic epilepsy, partial epilepsy such as complex partial epilepsy, frontal lobe epilepsy and temporal lobe epilepsy, post-traumatic epilepsy, status epilepticus such as Epilepsia Partialis Continua, and Hallervorden-Spatz Syndrome.

Additional neurologic diseases which can be treated with antibodies of the present invention include hydrocephalus such as Dandy-Walker Syndrome and normal pressure hydrocephalus, hypothalamic diseases such as hypothalamic neoplasms, cerebral malaria, narcolepsy which includes cataplexy, bulbar poliomyelitis, cerebri pseudotumor, Rett Syndrome, Reye's Syndrome, thalamic diseases, cerebral toxoplasmosis, intracranial tuberculoma and Zellweger Syndrome, CNS infections such as AIDS Dementia Complex, Brain Abscess, subdural empyema, encephalomyelitis such as Equine Encephalomyelitis, Venezuelan Equine Encephalomyelitis, Necrotizing Hemorrhagic Encephalomyelitis, Visna, and cerebral malaria.

Additional neurologic diseases which can be treated with antibodies of the present invention include meningitis such as arachnoiditis, aseptic meningtitis such as viral meningtitis which includes lymphocytic choriomeningitis, Bacterial meningtitis which includes Haemophilus Meningtitis, Listeria Meningritis, Meningococcal Meningtitis such as Waterhouse-Friderichsen Syndrome, Pneumococcal Meningtitis and meningeal tuberculosis, fungal meningitis such as Cryptococcal Meningtitis, subdural effusion, meningoencephalitis such as uvemeningoencephalitic syndrome, myelitis such as transverse myelitis, neurosyphilis such as tabes dorsalis, poliomyelitis which includes bulbar poliomyelitis and post-poliomyelitis syndrome, prion diseases (such as Creutzfeldt-Jakob Syndrome, Bovine Spongiform Encephalopathy, Gerstmann-Straussler Syndrome, Kuru, Scrapie), and cerebral toxoplasmosis.

Additional neurologic diseases which can be treated with antibodies of the present invention include CNS neoplasms such as brain neoplasms that include cerebellar neoplasms such as infratentorial neoplasms, cerebral ventricle neoplasms such as choroid plexus neoplasms, hypothalamic neoplasms and supratentorial neoplasms, meningeal neoplasms, spinal cord neoplasms which include epidural neoplasms, demyelinating diseases such as Canavan Diseases, diffuse cerebral sceloris which includes adrenoleukodystrophy, encephalitis periaxialis, globoid cell leukodystrophy, diffuse cerebral sclerosis such as metachromatic leukodystrophy, allergic encephalomyelitis, necrotizing hemorrhagic encephalomyelitis, progressive multifocal leukoencephalopathy, multiple sclerosis, central pontine myelinolysis, transverse myelitis, neuromyelitis optica, Scrapie, Swayback, Chronic Fatigue Syndrome, Visna, High Pressure Nervous Syndrome, Meningism, spinal cord diseases such as amyotonia congenita, amyotrophic lateral sclerosis, spinal muscular atrophy such as Werdnig-Hoffmann Disease, spinal cord compression, spinal cord neoplasms such as epidural neoplasms, syringomyelia, Tabes Dorsalis, Stiff-Man Syndrome, mental retardation such as Angelman Syndrome, Cri-du-Chat Syndrome, De Lange's Syndrome, Down Syndrome, Gangliosidoses such as gangliosidoses G(M1), Sandhoff Disease, Tay-Sachs Disease, Hartnup Disease, homocystinuria, Laurence-Moon-Biedl Syndrome, Lesch-Nyhan Syndrome, Maple Syrup Urine Disease, mucolipidosis such as fucosidosis, neuronal ceroid-lipofuscinosis, oculocerebrorenal syndrome, phenylketonuria such as maternal phenylketonuria, Prader-Willi Syndrome, Rett Syndrome, Rubinstein-Taybi Syndrome, Tuberous Sclerosis, WAGR Syndrome, nervous system abnormalities such as holoprosencephaly, neural tube defects such as anencephaly which includes hydrangencephaly, Arnold-Chain Deformity, encephalocele, meningocele, meningomyelocele, spinal dysraphism such as spina bifida cystica and spina bifida occulta.

Additional neurologic diseases which can be treated with antibodies of the present invention include hereditary motor and sensory neuropathies which include Charcot-Marie Disease, Hereditary optic atrophy, Refsum's Disease, hereditary spastic paraplegia, Werdnig-Hoffmann Disease, Hereditary Sensory and Autonomic Neuropathies such as Congenital Analgesia and Familial Dysautonomia, Neurologic manifestations (such as agnosia that include Gerstmann's Syndrome, Amnesia such as retrograde amnesia, apraxia, neurogenic bladder, cataplexy, communicative disorders such as hearing disorders that includes deafness, partial hearing loss, loudness recruitment and tinnitus, language disorders such as aphasia which include agraphia, anomia, broca aphasia, and Wernicke Aphasia, Dyslexia such as Acquired Dyslexia, language development disorders, speech disorders such as aphasia which includes anomia, broca aphasia and Wernicke Aphasia, articulation disorders, communicative disorders such as speech disorders which include dysarthria, echolalia, mutism and stuttering, voice disorders such as aphonia and hoarseness, decerebrate state, delirium, fasciculation, hallucinations, meningism, movement disorders such as angelman syndrome, ataxia, athetosis, chorea, dystonia, hypokinesia, muscle hypotonia, myoclonus, fic, torticollis and tremor, muscle hypertonia such as muscle rigidity such as stiff-man syndrome, muscle spasticity, paralysis such as facial paralysis which includes Herpes Zoster Oticus, Gastroparesis, Hemiplegia, ophthalmoplegia such as diplopia, Duane's Syndrome, Homer's Syndrome, Chronic progressive external ophthalmoplegia such as Kearns Syndrome, Bulbar Paralysis, Tropical Spastic Paraparesis, Paraplegia such as Brown-Sequard Syndrome, quadriplegia, respiratory paralysis and vocal cord paralysis, paresis, phantom limb, taste disorders such as ageusia and dysgeusia, vision disorders such as amblyopia, blindness, color vision defects, diplopia, hemianopsia, scotoma and subnormal vision, sleep disorders such as hypersomnia which includes Keine-Levin Syndrome, insomnia, and somnambulism, spasm such as trismus, unconsciousness such as coma, persistent vegetative state and syncope and vertigo, neuromuscular diseases such as amyotonia congenita, amyotrophic lateral sclerosis, Lambert-Eaton Myasthenic Syndrome, motor neuron disease, muscular atrophy such as spinal muscular atrophy, Charcot-Marie Disease and Werdnig-Hoffmann Disease, Postpoliomyelitis Syndrome, Muscular Dystrophy, Myasthenia Gravis, Myotonia Atrophica, Myotonia Confenita, Nemaline Myopathy, Familial Periodic Paralysis, Multiplex Paramyloclonus, Tropical Spastic Paraparesis and Stiff-Man Syndrome, peripheral nervous system diseases such as acrodynia, amyloid neuropathies, autonomic nervous system diseases such as Adie's Syndrome, Barre-Lieou Syndrome, Familial Dysautonomia, Homer's Syndrome, Reflex Sympathetic Dystrophy and Shy-Drager Syndrome, Cranial Nerve Diseases such as Acoustic Nerve Diseases such as Acoustic Neuroma which includes Neurofibromatosis 2, Facial Nerve Diseases such as Facial Neuralgia, Melkersson-Rosenthal Syndrome, ocular motility disorders which includes amblyopia, nystagmus, oculomotor nerve paralysis, ophthalmoplegia such as Duane's Syndrome, Homer's Syndrome, Chronic Progressive External Ophthalmoplegia which includes Kearns Syndrome, Strabismus such as Esotropia and Exotropia, Oculomotor Nerve Paralysis, Optic Nerve Diseases such as Optic Atrophy which includes Hereditary Optic Atrophy, Optic Disk Drusen, Optic Neuritis such as Neuromyelitis Optica, Papilledema, Trigeminal Neuralgia, Vocal Cord Paralysis, Demyelinating Diseases such as Neuromyelitis Optica and Swayback, and Diabetic neuropathies such as diabetic foot.

Additional neurologic diseases which can be treated with antibodies of the present invention include nerve compression syndromes such as carpal tunnel syndrome, tarsal tunnel syndrome, thoracic outlet syndrome such as cervical rib syndrome, ulnar nerve compression syndrome, neuralgia such as causalgia, cervico-brachial neuralgia, facial neuralgia and trigeminal neuralgia, neuritis such as experimental allergic neuritis, optic neuritis, polyneuritis, polyradiculoneuritis and radiculities such as polyradiculitis, hereditary motor and sensory neuropathies such as Charcot-Marie Disease, Hereditary Optic Atrophy, Refsum's Disease, Hereditary Spastic Paraplegia and Werdnig-Hoffmann Disease, Hereditary Sensory and Autonomic Neuropathies which include Congenital Analgesia and Familial Dysautonomia, POEMS Syndrome, Sciatica, Gustatory Sweating and Tetany).

Hyperproliferative Disorders

Antibodies of the present invention can be used to treat, prevent, and/or diagnose hyperproliferative diseases, disorders, and/or conditions, including neoplasms. Antibodies against NogoR may inhibit the proliferation of the disorder through direct or indirect interactions.

Examples of hyperproliferative diseases, disorders, and/or conditions that can be treated, prevented, and/or diagnosed by the antibodies of the present invention include, but are not limited to neoplasms located in the: nervous system (central and peripheral), colon, abdomen, bone, breast, digestive system, liver, pancreas, peritoneum, endocrine glands (adrenal, parathyroid, pituitary, testicles, ovary, thymus, thyroid), eye, head and neck, lymphatic system, pelvic, skin, soft tissue, spleen, thoracic, and urogenital.

In specific embodiments, antibodies of the invention that bind NogoR are used to treat, prevent or ameliorate cancers of the central nervous system such as medulloblastoma, neuroblastoma, and glioblastoma.

Similarly, other hyperproliferative diseases, disorders, and/or conditions can also be treated, prevented, and/or diagnosed by antibodies of the present invention. Examples of such hyperproliferative diseases, disorders, and/or conditions include, but are not limited to: hypergammaglobulinemia, lymphoproliferative diseases, disorders, and/or conditions, paraproteinemias, purpura, sarcoidosis, Sezary Syndrome, Waldenstron's Macroglobulinemia, Gaucher's Disease, histiocytosis, and any other hyperproliferative disease, besides neoplasia, located in an organ system listed above.

NogoR antibodies of the present invention may be useful for preventing the expression of oncogenic genes. By interfering with NogoR activity, NogoR antibodies may prevent the signal transduction to initiate the expression of oncogenic genes. NogoR antibodies can possibly suppress of the transcription of the oncogene, prevent post-translational modifications of the protein, or the inhibit the normal function of the protein.

The present invention is further directed to antibody-based therapies which involve administering of antibodies of the invention to a mammalian, preferably human, patient for treating, preventing, and/or diagnosing one or more of the described diseases, disorders, and/or conditions. Such antibodies may be provided in pharmaceutically acceptable compositions as known in the art or as described herein.

A summary of the ways in which the antibodies of the present invention may be used therapeutically includes binding NogoR locally or systemically in the body or by direct cytotoxicity of the antibody, e.g. as mediated by complement (CDC) or by effector cells (ADCC). Some of these approaches are described in more detail below. Armed with the teachings provided herein, one of ordinary skill in the art will know how to use the antibodies of the present invention for diagnostic, monitoring or therapeutic purposes without undue experimentation.

In particular, the antibodies, fragments and derivatives of the present invention are useful for treating, preventing, and/or diagnosing a subject having or developing cell proliferative and/or differentiation diseases, disorders, and/or conditions as described herein. Such treatment comprises administering a single or multiple doses of the antibody, or a fragment, derivative, or a conjugate thereof.

Antibodies of the present invention, or fragments thereof may be useful in inhibiting proliferative cells or tissues through the induction of apoptosis. Said antibodies may act either directly, or indirectly to induce apoptosis of proliferative cells and tissues, for example in the activation of a death-domain receptor, such as tumor necrosis factor (TNF) receptor-1, CD95 (Fas/APO-1), TNF-receptor-related apoptosis-mediated protein (TRAMP) and TNF-related apoptosis-inducing ligand (TRAIL) receptor-1 and -2 (See Schulze-Osthoff et al., *Eur J Biochem* 254(3):439-59 (1998), which is hereby incorporated by reference). Moreover, in another preferred embodiment of the present invention, said antibodies may induce apoptosis through other mechanisms, such as in the activation of other proteins which will activate apoptosis, or through stimulating the expression of said proteins, either alone or in combination with small molecule drugs or adjuviants, such as apoptonin, galectins, thioredoxins, anti-inflammatory proteins (See for example, *Mutat Res* 400(1-2):

447-55 (1998), *Med Hypotheses* 50(5):423-33 (1998), *Chem Biol Interact* 24;111-112:23-34 (1998), *J Mol Med* 76(6): 402-12 (1998), *Int J Tissue React* 20(1):3-15 (1998), which are all hereby incorporated by reference).

Antibodies or fragments thereof of the present invention are useful in inhibiting the metastasis of proliferative cells or tissues. Inhibition may occur as a direct result of administering antibodies against NogoR as described elsewere herein, or indirectly, such as activating the expression of proteins known to inhibit metastasis, for example alpha 4 integrins, (See, e.g., *Curr Top Microbiol Immunol* 1998; 231:125-41, which is hereby incorporated by reference). Such thereapeutic affects of the present invention may be achieved either alone, or in combination with small molecule drugs or adjuvants.

In another embodiment, the invention provides a method of delivering compositions containing the antibodies of the invention (e.g., compositions containing antibodies associated with heterologous polypeptides, heterologous nucleic acids, toxins, or prodrugs) to targeted cells expressing NogoR. Antibodies of the invention may be associated with heterologous polypeptides, heterologous nucleic acids, toxins, or prodrugs via hydrophobic, hydrophilic, ionic and/or covalent interactions.

Therapeutic Compositions and Administration Across the Blood Brain Barrier

Targeting therapeutics to the CNS is difficult due to the presence of the blood brain barrier (BBB). Any drug used to treat cells of the CNS must pass through the BBB, a membranous barrier that tightly segregates the brain/spinal cord from the circulating blood (Misra et al., *J Pharm Pharmaceut Sci* 6:252-273 (2003) which is hereby incorporated by reference in its entirety). Strategies have been developed which facilitate the traversal of drugs into the brain/spinal cord.

In one embodiment, antibodies of the present invention are delivered to the nervous by intrathecal injection, by intralumbar injection, by intraventricular infusion, by intracerebral administration or by injection into the circumventricular organs (CVOs). Intrathecal, intralumbar, intraventricular and intracerebral administration directly presents the drug into the cerebrospinal fluid (CSF). It should be noted that entry of a drug into the CSF does not guarantee efficacious entry into the brain/spinal cord as two additional barriers exist, the blood-CSF barrier and the brain-CSF barrier. Injection into the CVOs allow passage of molecules into the CNS as the BBB is more permeable in these regions. The CVOs include, but are not limited to, the choroid plexus, the median eminence, the subfomical organ, the organum vasculosum of the lamina terminalis, the area postrema, the neurohypophysis, the pineal gland, and the subcommisaral organ. In another embodiment, antibodies of the present invention may be delivered intranasally.

In another embodiment, antibodies of the present invention are maintained in the nervous system by disrupting the transport mechanisms of drugs/proteins from the BBB. Lowering the active efflux of drugs from the CNS will allow a higher concentration of the therapeutic in CNS for greater efficacy. The majority of the efflux transporters present at the BBB are multi-drug resistance transporters and organic anion transporters. Thus, examples of molecules that disrupt the efflux mechanism of the BBB include, but are not limited to, inhibitors of P-glycoprotein (Pgp), multi-drug resistance protein, multi-specific organic anion transports, oligopeptide transporter, monocarboxylic acid transporter, anion antiporter, organic anion transporters, organic cation/carnitine transporters (OCTNs), nucleoside transporters, large amino-acid transporters, transferrin-1 and -2 receptors, the scavenger receptors SB-AI and SB-BI, and members of the ABC cassette of transport proteins.

In another embodiment, antibodies of the present invention are delivered to the nervous system by increasing the influx of drugs/proteins across the BBB. This can be achieved in at least one of three ways: (1) taking advantage of the transport proteins which actively transport drugs/proteins into the BBB; (2) altering the permeability of the endothelial cells that comprise the BBB; and (3) manipulating the drug so that passage across the BBB is achieved.

Several transport pathways are present at the BBB to allow for passage of nutrients and peptides. These pathways can be used to transport drugs into the nervous system. Examples of such pathways include, but are not limited to, the hexose transport system, the neutral amino acid transport system, the acidic amino acid transport system, the basic amino acid transport system, the b-amino acid transport system, the monocarboxylic acid transport system, the choline transport system, the amine transport system, the nucleoside transport system, and the peptide transport system. In another embodiment, the drug that needs to cross the BBB is covalently or non-covalently attached to a protein which normally undergoes transport across the BBB. After transport across the BBB, this chimeric protein may be cleaved to release the pharmacologically active drug from the transport protein. Alternatively, the chimeric protein may retain pharmacological activity while still attached to the transport protein. In another embodiment, drugs are covalently or non-covalently attached to proteins which undergo receptor-mediated transcytosis.

The permeability of the endothelial that comprise the BBB may be disrupted using chemical means. In one embodiment, antibodies of the present invention may traverse the BBB by administering drugs and/or treatments which increase the permeability of the BBB. Such drugs and/or treatments include, but are not limited to, osmotic agents, X-ray irradiation, ethanol, retinoic acid, phorbol myristate acetate, dimethyl sulfoxide, metrazol, VP-16, cisplatin, hydroxylurea, flurouracil, cholinomimetic arecolines, etoposide, leukotriene C4, bradykinin, histamine, and RMP-7, a bradykinin analog.

Since uncharged, lipophilic molecules preferentially traverse the BBB, modifying drugs to possess these characteristics may allow for the passage of drugs into the BBB. In one embodiment, antibodies of the present invention may packaged in liposomes to facilitate entry into the nervous system.

Another effective strategy to deliver therapeutic drugs into the BBB involves its conversion of a pharmacologically inactive precursor or derivatives into a pharmacologically active drug only after it has entered the BBB. This may be achieved via enzymatic and/or chemical transformations. One advantage in delivering drugs via this strategy is that if a drug is entered into the BBB as a lipophilic compound and is converted into a lipid-insoluble molecule, the drug is "locked-in" and remains within the BBB.

Presenting drugs directly into the brain interstitium is another possible method to bypass the BBB. In one embodiment, antibodies of the present invention are delivered to the brain interstitium using an implantable pump. In another embodiment, antibodies of the present invention are delivered to the brain interstitium via a catheter. In yet another embodiment, antibodies of the present invention are delivered to the brain interstitium via direct injection.

Taking advantage of new technology, antibodies of the present invention can also be directly delivered into the nervous system using biodegradable wafers, microspheres, and nanoparticles. Among its advantages is the sustained controlled drug release.

Antibodies of the present invention may also be directly delivered into the brain and spinal cord by grafting cells engineered to express the antibodies. Gene therapy using the antibodies of the present invention are discussed in detail below.

Therapeutic Compositions and Administration

The invention provides methods of treatment or amelioration by administration to a subject of an effective amount of antibody (or fragment or variant thereof) or pharmaceutical composition of the invention, preferably an antibody of the invention. In a preferred aspect, an antibody or fragment or variant thereof is substantially purified (i.e., substantially free from substances that limit its effect or produce undesired side-effects). The subject is preferably an animal, including but not limited to, animals such as cows, pigs, horses, chickens, cats, dogs, etc., and is preferably a mammal, and most preferably a human.

Formulations and methods of administration that can be employed when the compound comprises a nucleic acid or an immunoglobulin are described above; additional appropriate formulations and routes of administration can be selected from among those described herein below.

Various delivery systems are known and can be used to administer antibody or fragment or variant thereof of the invention, e.g., encapsulation in liposomes, microparticles, microcapsules, recombinant cells capable of expressing the antibody or antibody fragment, receptor-mediated endocytosis (see, e.g., Wu and Wu, *J Biol Chem* 262:4429-4432 (1987)), construction of a nucleic acid as part of a retroviral or other vector, etc. Methods of introduction include, but are not limited to, intradermal, intramuscular, intraperitoneal, intravenous, subcutaneous, intranasal, epidural, and oral routes. The compositions may be administered by any convenient route, for example by infusion or bolus injection, by absorption through epithelial or mucocutaneous linings (e.g., oral mucosa, rectal and intestinal mucosa, etc.) and may be administered together with other biologically active agents. Administration can be systemic or local. In addition, it may be desirable to introduce the pharmaceutical compositions of the invention into the CNS by any suitable route, including intraventricular and intrathecal injection; intraventricular injection may be facilitated by an intraventricular catheter, for example, attached to a reservoir, such as an Ommaya reservoir. Pulmonary administration can also be employed, e.g. by use of an inhaler or nebulizer, and formulation with an aerosolizing agent.

In a specific embodiment, it may be desirable to administer the pharmaceutical compositions of the invention locally to the area in need of treatment; this may be achieved by, for example, and not by way of limitation, local infusion during surgery, topical application, e.g., in conjunction with a wound dressing after surgery, by injection, by means of a catheter, by means of a suppository, or by means of an implant, said implant being of a porous, non-porous, or gelatinous material, including membranes, such as sialastic membranes, or fibers. Preferably, when administering a protein, including an antibody, of the invention, care must be taken to use materials to which the protein does not absorb.

In another embodiment, the composition can be delivered in a vesicle, in particular a liposome (see Langer, *Science* 249:1527-1535 (1990); Treat et al., in Liposomes in the Therapy of Infectious Disease and Cancer, Lopez-Berestein and Fidler (eds.), Liss, New York, pp. 353-365 (1989); Lopez-Berestein, ibid., pp. 317-327; see generally ibid.).

In yet another embodiment, the composition can be delivered in a controlled release system. In one embodiment, a pump may be used (see Langer, supra; Sefton, *CRC Crit Ref Biomed Eng* 14:201 (1987); Buchwald et al., *Surgery* 88:507 (1980); Saudek et al., *N Engl J Med* 321:574 (1989)). In another embodiment, polymeric materials can be used (see Medical Applications of Controlled Release, Langer and Wise (eds.), CRC Pres., Boca Raton, Fla. (1974); Controlled Drug Bioavailability, Drug Product Design and Performance, Smolen and Ball (eds.), Wiley, New York (1984); Ranger and Peppas, J., Macromol. Sci. Rev. Macromol. Chem. 23:71 (1983); see also Levy et al., *Science* 228:190 (1985); During et al., *Ann Neurol* 25:351 (1989); Howard et al., *J Neurosurg* 71:105 (1989)). In yet another embodiment, a controlled release system can be placed in proximity of the therapeutic target, i.e., the brain, thus requiring only a fraction of the systemic dose (see, e.g., Goodson, in Medical Applications of Controlled Release, supra, vol. 2, pp. 115-138 (1984)).

Other controlled release systems are discussed in the review by Langer, *Science* 249:1527-1535 (1990).

In a specific embodiment where the composition of the invention is a nucleic acid encoding a protein, the nucleic acid can be administered in vivo to promote expression of its encoded protein, by constructing it as part of an appropriate nucleic acid expression vector and administering it so that it becomes intracellular, e.g., by use of a retroviral vector (see U.S. Pat. No. 4,980,286), or by direct injection, or by use of microparticle bombardment (e.g., a gene gun; Biolistic, DUPONT™), or coating with lipids or cell-surface receptors or transfecting agents, or by administering it in linkage to a homeobox-like peptide which is known to enter the nucleus (see e.g., Joliot et al., *Proc Natl Acad Sci USA* 88:1864-1868 (1991)), etc. Alternatively, a nucleic acid can be introduced intracellularly and incorporated within host cell DNA for expression, by homologous recombination.

The present invention also provides pharmaceutical compositions. Such compositions comprise a therapeutically effective amount of an antibody or a fragment thereof, and a pharmaceutically acceptable carrier. In a specific embodiment, the term "pharmaceutically acceptable" means approved by a regulatory agency of the Federal or a state government or listed in the U.S. Pharmacopeia or other generally recognized pharmacopeia for use in animals, and more particularly in humans. The term "carrier" refers to a diluent, adjuvant, excipient, or vehicle with which the therapeutic is administered. Such pharmaceutical carriers can be sterile liquids, such as water and oils, including those of petroleum, animal, vegetable or synthetic origin, such as peanut oil, soybean oil, mineral oil, sesame oil and the like. Water is a preferred carrier when the pharmaceutical composition is administered intravenously. Saline solutions and aqueous dextrose and glycerol solutions can also be employed as liquid carriers, particularly for injectable solutions. Suitable pharmaceutical excipients include starch, glucose, lactose, sucrose, gelatin, malt, rice, flour, chalk, silica gel, sodium stearate, glycerol monostearate, talc, sodium chloride, dried skim milk, glycerol, propylene, glycol, water, ethanol and the like. The composition, if desired, can also contain minor amounts of wetting or emulsifying agents, or pH buffering agents. These compositions can take the form of solutions, suspensions, emulsion, tablets, pills, capsules, powders, sustained-release formulations and the like. The composition can be formulated as a suppository, with traditional binders and carriers such as triglycerides. Oral formulation can include standard carriers such as pharmaceutical grades of mannitol, lactose, starch, magnesium stearate, sodium saccharine, cellulose, magnesium carbonate, etc. Examples of suitable pharmaceutical carriers are described in "Remington's Pharmaceutical Sciences" by E. W. Martin. Such compositions will contain a therapeutically effective amount of the antibody or fragment thereof, preferably in purified form, together with a suitable amount of carrier so as to provide the form for proper administration to the patient. The formulation should suit the mode of administration.

In a preferred embodiment, the composition is formulated in accordance with routine procedures as a pharmaceutical composition adapted for intravenous administration to human beings. Typically, compositions for intravenous administration are solutions in sterile isotonic aqueous buffer. Where necessary, the composition may also include a solubilizing agent and a local anesthetic such as lignocaine to ease pain at the site of the injection. Generally, the ingredients are supplied either separately or mixed together in unit dosage form, for example, as a dry lyophilized powder or water free concentrate in a hermetically sealed container such as an ampoule or sachette indicating the quantity of active agent. Where the composition is to be administered by infusion, it can be dispensed with an infusion bottle containing sterile pharmaceutical grade water or saline. Where the composition is administered by injection, an ampoule of sterile water for injection or saline can be provided so that the ingredients may be mixed prior to administration.

The compositions of the invention can be formulated as neutral or salt forms. Pharmaceutically acceptable salts include those formed with anions such as those derived from hydrochloric, phosphoric, acetic, oxalic, tartaric acids, etc., and those formed with cations such as those derived from sodium, potassium, ammonium, calcium, ferric hydroxides, isopropylamine, triethylamine, 2-ethylamino ethanol, histidine, procaine, etc.

The amount of the composition of the invention which will be effective in the treatment, inhibition and prevention of a disease or disorder associated with aberrant expression and/or activity of a polypeptide of the invention can be determined by standard clinical techniques. In addition, in vitro assays may optionally be employed to help identify optimal dosage ranges. The precise dose to be employed in the formulation will also depend on the route of administration, and the seriousness of the disease or disorder, and should be decided according to the judgment of the practitioner and each patient's circumstances. Effective doses may be extrapolated from dose-response curves derived from in vitro or animal model test systems.

For antibodies, the dosage administered to a patient is typically 0.1 mg/kg to 100 mg/kg of the patient's body weight. Preferably, the dosage administered to a patient is between 0.1 mg/kg and 50 mg/kg of the patient's body weight. In specific embodiments, the dosage administered to a patient is 10 mg/kg of the patient's body weight. In other embodiments, the dosage administered to a patient is 20 mg/kg of the patient's body weight. In other embodiments, the dosage administered to a patient is 30 mg/kg of the patient's body weight. In other embodiments, the dosage administered to a patient is 40 mg/kg of the patient's body weight. Generally, human antibodies have a longer half-life within the human body than antibodies from other species due to the immune response to the foreign polypeptides. Thus, lower dosages of human antibodies and less frequent administration is often possible. Further, the dosage and frequency of administration of therapeutic or pharmaceutical compositions of the invention may be reduced by enhancing uptake and tissue penetration (e.g. into the brain) of the antibodies by modifications such as, for example, lipidation.

Generally, administration of products of a species origin or species reactivity (in the case of antibodies) that is the same species as that of the patient is preferred. Thus, in a preferred embodiment, human antibodies, fragments, or variants, (e.g., derivatives), or nucleic acids, are administered to a human patient for therapy or prophylaxis.

It is preferred to use high affinity and/or potent in vivo inhibiting and/or neutralizing antibodies of the invention (including molecules comprising, or alternatively consisting of, antibody fragments or variants thereof) that specifically bind to NogoR, or polynucleotides encoding antibodies that specifically bind to NogoR, for both immunoassays and administration to patients. Such antibodies will preferably have an affinity for NogoR and/or NogoR polypeptide fragments. Preferred binding affinities include those with a dissociation constant or $K_D$ of less than or equal to $5\times10^{-2}$ M, $10^{-2}$ M, $5\times10^{-3}$ M, $10^{-3}$ M, $5\times10^{-4}$ M, $10^{-4}$ M, $5\times10^{-5}$ M, or $10^{-5}$ M. More preferably, antibodies of the invention bind NogoR polypeptides or fragments or variants thereof with a dissociation constant or $K_D$ less than or equal to $5\times10^{-6}$ M, $10^{-6}$ M, $5\times10^{-7}$ M, $10^{-7}$ M, $5\times10^{-8}$ M, or $10^{-8}$ M. Even more preferably, antibodies of the invention bind NogoR polypeptides or fragments or variants thereof with a dissociation constant or $K_D$ less than or equal to $5\times10^{-9}$ M, $10^{-9}$ M, $5\times10^{-10}$ M, $10^{-10}$ M, $5\times10^{-11}$ M, $10^{-11}$ M, $5\times10^{-12}$ M, $10^{-12}$ M, $5\times10^{-13}$ M, $10^{-13}$ M, $5\times10^{-14}$ M, $10^{-14}$ M, $5\times10^{-15}$ M, or $10^{-15}$ M.

As discussed in more detail below, the antibodies of the present invention may be used either alone or in combination with other compositions. The antibodies may further be recombinantly fused to a heterologous polypeptide at the N- or C-terminus or chemically conjugated (including covalent and non-covalent conjugations) to polypeptides or other compositions. For example, antibodies of the present invention may be recombinantly fused or conjugated to molecules useful as labels in detection assays and effector molecules such as heterologous polypeptides, drugs, radionuclides, or toxins. See, e.g., PCT publications WO 92/08495; WO 91/14438; WO 89/12624; U.S. Pat. No. 5,314,995; and EP 396,387.

The antibody and antibody compositions of the invention may be administered alone or in combination with other therapeutic agents, including but not limited to antibiotics, antivirals, anti-retroviral agents, steroidal and non-steroidal anti-inflammatories, conventional immunotherapeutic agents and cytokines. Combinations may be administered either concomitantly, e.g., as an admixture, separately but simultaneously or concurrently; or sequentially. This includes presentations in which the combined agents are administered together as a therapeutic mixture, and also procedures in which the combined agents are administered separately but simultaneously, e.g., as through separate intravenous lines into the same individual. Administration "in combination" further includes the separate administration of one of the compounds or agents given first, followed by the second.

In some embodiments, antibodies of the invention that are administered to an animal, preferably a human, for therapeutic or prophylactic uses are multimeric antibodies. In specific embodiments, antibodies of the invention are homodimeric IgG molecules. In other specific embodiments, antibodies of the invention are homodimeric IgG1 molecules. In specific embodiments, antibodies of the invention are homotrimeric IgG molecules. In other specific embodiments, antibodies of the invention are trimeric IgG1 molecules. In other specific embodiments, antibodies of the invention are higher-order multimers of IgG molecules (e.g., tetramers, penatmers and hexamers). In still further specific embodiments, antibodies of the IgG molecules comprising the higher order multimers of IgG molecules are IgG1 molecules.

Alternatively, antibodies of the invention for therapeutic or prophylactic uses may be administered in combination with crosslinking agents known in the art, including but not limited to anti-IgG antibodies.

Combination Administration with Other Agents or Means Used in the Treatment of Spinal Cord Injuries The antibodies of the invention (including molecules comprising, or alternatively consisting of, antibody fragments or variants thereof) may be administered alone or in combination with other therapeutic or prophylactic regimens (e.g., radiation therapy, chemotherapy, hormonal therapy, stem cell transplantation, immunotherapy, anti-tumor agents, anti-angiogenesis and anti-inflammatory agents). Currently, experimental treatments/therapies for spinal cord injuries fall into seven categories: (1) neuroprotective; (2) neuroreparative; (3) neurotrophic; (4) neuroregenerative; (5) neurorestorative; (6) neuroconstructive; and (7) neurogenetic. Each category addresses different aspects of treating and/or ameliorating spinal cord injuries. Antibodies of the current invention can be combined with the experimental therapies listed herein. Such combinatorial therapy may be administered sequentially and/or concomitantly.

The antibodies of the invention may be administered prophylactically or therapeutically. It is specifically contemplated that the antibodies of the invention may be administered to restore function (i.e., movement and/or sensation) or ameliorate paralysis as a supplementary or supportive measure in addition to standard prophylactic or therapeutic treatments for spinal cord injuries. For example, administration of methylprednisolone is one of the only conventional treatments for spinal cord injuries. However, methylprednisolone is ineffective if it is not administered within eight hours after injury. Thus, conventional treatment is not beneficial to patients with pre-existing spinal cord injuries. In one embodiment of the invention, the antibodies of the invention may be administered as a supportive or supplemental therapy for an individual undergoing methylprednisolone treatment for spinal cord injuries. Another exemplary use of the antibodies of the invention is as a supportive therapy during the time period following methylprednisolone treatment in order to promote axonal regeneration.

The primary purpose of neuroprotective therapies is to prevent further damage to the spinal cord after insult. Neuroprotective agents can prevent necrosis, prevent apoptosis, modulate mammalian gene expression, or prevent inflammation. The antibodies of the present invention may be administered in combination with one or more neuroprotective agents such as glucocorticoids, tetracyclines, glutamate receptor blockers, GABA receptor antagonists and cycloxygenase blockers. In specific embodiments, anti-NogoR antibodies of the invention may be administered in combination with one or more glucocorticoid such as methylprednisolone. In another specific embodiment, anti-NogoR antibodies of the invention may be administered in combination with one or more tetracycline antibiotics such as minocycline. In yet another specific embodiments, antibodies of the present invention may be administered in combination with one or more glutamate receptor blockers such as MK801 or agmantine. In yet another specific embodiments, anti-NogoR antibodies of the invention may be administered in combination with one or more GABA receptor antagonists such as pregnenolone or glutamine synthetase. In another specific embodiment, anti-NogoR antibodies of the invention may be administered in combination with one or more cycloxygenase blockers such as indomethacin, ibuprofen, COX-2 inhibitors (such as VIOXX™ or CELEBREX™) or acetominophen (commonly known as TYLENOL™).

Neuroreparative therapies aim to facilitate and promote repair of the spinal cord during the weeks that follow spinal cord injury. Neuroreparative agents stimulate cells to engage in repair and refinement. The antibodies of the present invention may be administered in combination with one or more neuroreparative agents such as protein kinase modulators, inflammatory cells, and lymphocyte activators. In specific embodiments, anti-NogoR antibodies of the invention may be administered in combination with one or more protein kinase modulators such as monosialic ganglioside (GM1). In another specific embodiment, anti-NogoR antibodies of the invention may be administered in combination with one or more inflammatory cells such as activated macrophages or activated T-lymphocytes. In yet another specific embodiments, antibodies of the present invention may be administered in combination with one or more lymphocyte activators such as myelin basic protein, glatiramer acetate (COPAXONE™) or a Nogo vaccine.

Neurotrophic therapies seek to promote axonal growth from the injured or existing adult neurons present at the lesion site. Neurotrophic agents include classic growth factors and small molecules which promote axon/neurite sprouting, but also include molecules which block the axon's response to growth inhibitors. The antibodies of the present invention may be administered in combination with one or more neurotrophic agents such as protein growth factors, purine nucleotides, cell adhesion molecules, and hormones. In specific embodiments, anti-NogoR antibodies of the invention may be administered in combination with one or more protein growth factors such as nerve growth factor, brain derived growth factor, neurotrophin-3, neurotrophin-4, fibroblast growth factor, or glial derived growth factor. In another specific embodiment, anti-NogoR antibodies of the invention may be administered in combination with one or more purine nucleotides such as AIT-082 (NEOTROFIN™), inosine, AF-1, or adenosine. In yet another specific embodiments, antibodies of the present invention may be administered in combination with one or more cell adhesion molecule such as L1 (including fargement of L1 and L1-FC fusion proteins, tenascin, or laminin. In yet another specific embodiments, anti-NogoR antibodies of the invention may be administered in combination with one or more hormones such as adrenocorticotropic hormone, melanotropin, growth hormone, estrogen, or testosterone.

Neurorestorative therapies aim to restore function to the demyelinated spinal cord by increasing the excitability of axons so that they can conduct current despite their state of demyelination. Restorative therapies also focus on counteracting the imbalance of neurotransmitters. Neuroreparative therapies are often temporary. The antibodies of the present invention may be administered in combination with one or more neurorestorative agents such as potassium channel blockers, neurotransmitter therapies, electrical stimulation, and forced use training. In specific embodiments, anti-NogoR antibodies of the invention may be administered in combination with one or more potassium channel blockers such as 4-aminopyridine or 2,4-diaminopyridine. In another specific embodiment, anti-NogoR antibodies of the invention may be administered in combination with one or more neurotransmitter therapies such as serotonin, clonidine, or tizanidine. In yet another specific embodiments, antibodies of the present invention may be administered in combination with one or more electrical stimulation such as stimulation of the central pattern generator or functional electrical stimulation. In yet another specific embodiment, anti-NogoR antibodies can be administered in combination with one or more forced-use training such as contraint-induced therapy, supported treadmill ambulation, or biofeedback therapy.

Neuroregenerative therapies seek to facilitate axon growth over long distances. Neuroregenerative therapy differs from neurotrophic therapy in that while neurotrophic therapy may case axon growth and sprouting, other therapy is necessary to have axons synapse with their targets. Neuroregenerative agents can be thought in inactivate axon growth inhibitors; neuroregenerative agenst can also target upstream or downstream targets or promoters. The antibodies of the present invention may be administered in combination with one or more neuroregenerative agents such as Nogo antagonists, NogoR antagonists, chondroitinase, therapeutic vaccines, upstream messenger promoters, upstream messenger blockers, and downstream growth messengers. In specific embodiments, anti-NogoR antibodies of the invention may be administered in combination with one or more Nogo antagonists such as Dantrolene, humanized IN-1, or human anti-Nogo antibodies. In another specific embodiment, anti-NogoR antibodies of the invention may be administered in combination with one or more NogoR antagonists such as NogoREcto (See Fournier et al., *J Neurosci* 22:8876-8883 (2002). In yet another specific embodiments, antibodies of the present invention may be administered in combination with one or more chondroitinases such as chondroitinase ABC. In specific embodiments, anti-NogoR antibodies of the invention may be administered in combination with one or more therapeutic vaccines such as spinal cord homogenate, myelin proteins, or glatiramer acetate (COPAXONE™). In another specific embodiment, anti-NogoR antibodies of the invention may be administered in combination with one or more upstream messenger promoters such as Rollipram, theophylline, monosialic ganglioside (GM1), or alternating electrical currents. In yet another specific embodiments, antibodies of the present invention may be administered in combination with one or more upstream messnger blockers such as C3 (a Rho inactivator). In another specific embodiment, anti-NogoR antibodies may be administered in combination with one or more downstream growth messengers such as spermidine, ornithine, or putrescine.

Neuroconstructive therapies seek to replace and replenishing the damaged cells at the site of lesion. Due to the pluripotent nature of stem cells, stem cells may provide the most promising approach to repopulate damaged or absent neurons, oligodendrocytes, which myelinate the axons, and astrocytes. The antibodies of the present invention may be administered in combination with one or more neuroconstructive agents such as fetal stem cell grafts, adult stem cell grafts, embryonic stem cell isografts, enteric glial stem cells, olfactory ensheathing glia, Schwann cells and precursor cells. In specific embodiments, anti-NogoR antibodies of the invention may be administered in combination with one or more fetal stem cell grafts such as porcine neural stem cell xenografts and human getal neural stem cells. In another specific embodiment, anti-NogoR antibodies of the invention may be administered in combination with one or more adult stem cell autografts such as human bone marrow stem cells, human fat stem cells, or human adult nasal epithelial stem cells. In yet another specific embodiments, antibodies of the present invention may be administered in combination with one or more embryonic stem cell isograft such as human embryonic stem cells or human cloned embryonic stem cells. In yet another specific embodiments, anti-NogoR antibodies of the invention may be administered in combination with one or more enteric glial stem cell such as adult isografts from the appendix, adult heterografts, or omentum transpositions. In another specific embodiment, anti-NogoR antibodies of the invention may be administered in combination with one or more olfactory ensheathing glial such as human olfactory ensheathing glial autograft, human fetal olfactory ensheathing glial heterografts, or porcine fetal olfactory ensheathing glial xenografts. In yet another specific embodiments, antibodies of the present invention may be administered in combination with one or more Schwann cells such as Schwann cell autografts. In yet another specific embodiments, anti-NogoR antibodies of the invention may be administered in combination with one or more restricted precursors such as neuron-restricted precursors, glial-restricted precursors or oligodendroglial precursor cells (O-2A). Cells used in the neuroconstructive therapies can also be cell-line derived.

Neurogenetic therapies aim to engineer gene expression directly in the spinal cord such that expression of a gene elicits its particular function, i.e., remyelination, regeneration, etc. Neurogenetic therapies is closely related to gene therapy which is discussed in detail below. The antibodies of the present invention may be administered in combination with one or more neurogenetic therapies such as genetically modified cell transplantation, DNA insertion, and use of viral vectors (adenoviral or retroviral).

Additional Combination Therapies

In other embodiments, antibody and antibody compositions of the invention may be administered in combination with anti-opportunistic infection agents. Anti-opportunistic agents that may be administered in combination with the antibody and antibody compositions of the invention, include, but are not limited to, DAPSONE™, PENTAMIDINE™, ATOVAQUONE™, ISONIAZID™, RIFAMPIN™, PYRAZINAMIDE™, ETHAMBUTOL™, RIFABUTIN™, CLARITHROMYCIN™, AZITHROMYCIN™, GANCICLOVIR™, FOSCARNET™, CIDOFOVIR™, FLUCONAZOLE™, ITRACONAZOLE™, KETOCONAZOLE™, ACYCLOVIR™, FAMCICOLVIR™, PYRIMETHAMINE™, LEUCOVORIN™, NEUPOGEN™ (filgrastim/G-CSF), and LEUKINE™ (sargramostim/GM-CSF). In a specific embodiment, antibody and antibody compositions of the invention are used in any combination with TRIMETHOPRIM-SULFAMETHOXAZOLE™, DAPSONE™, PENTAMIDINE™, and/or ATOVAQUONE™ to prophylactically treat, prevent, and/or diagnose an opportunistic *Pneumocystis carinii* pneumonia infection. In another specific embodiment, antibody and antibody compositions of the invention are used in any combination with ISONIAZID™, RIFAMPIN™, PYRAZINAMIDE™, and/or ETHAMBUTOL™ to prophylactically treat, prevent, and/or diagnose an opportunistic *Mycobacterium avium* complex infection. In another specific embodiment, antibody and antibody compositions of the invention are used in any combination with RIFABUTIN™, CLARITHROMYCIN™, and/or AZITHROMYCIN™ to prophylactically treat, prevent, and/or diagnose an opportunistic *Mycobacterium tuberculosis* infection. In another specific embodiment, antibody and antibody compositions of the invention are used in any combination with GANCICLOVIR™, FOSCARNET™, and/or CIDOFOVIR™ to prophylactically treat, prevent, and/or diagnose an opportunistic cytomegalovirus infection. In another specific embodiment, antibody and antibody compositions of the invention are used in any combination with FLUCONAZOLE™, ITRACONAZOLE™, and/or KETOCONAZOLE™ to prophylactically treat, prevent, and/or diagnose an opportunistic fungal infection. In another specific embodiment, antibody and antibody compositions of the invention are used in any combination with ACYCLOVIR™ and/or FAMCICOLVIR™ to prophylactically treat, prevent, and/or diagnose an opportunistic herpes simplex virus type I and/or type II infection. In another specific embodiment, antibody and antibody compositions of the invention are used in any combination with PYRIMETHAMINE™ and/or LEUCOVORIN™ to prophylactically treat, prevent, and/or diagnose an opportunistic *Toxoplasma gondii* infection. In another specific embodiment, antibody and antibody compositions of the invention are used in any combination with LEUCOVORIN™ and/or NEUPOGEN™ to prophylactically treat, prevent, and/or diagnose an opportunistic bacterial infection.

In a further embodiment, the antibody and antibody compositions of the invention are administered in combination with an antiviral agent. Antiviral agents that may be administered with the antibody and antibody compositions of the invention include, but are not limited to, acyclovir, ribavirin, amantadine, and remantidine.

In certain embodiments, therapeutics of the invention are administered in combination with antiretroviral agents, nucleoside/nucleotide reverse transcriptase inhibitors (NRTIs), non-nucleoside reverse transcriptase inhibitors (NNRTIs), and/or protease inhibitors (PIs). NRTIs that may be administered in combination with the therapeutics of the invention, include, but are not limited to, RETROVIR™ (zidovudine/AZT), VIDEX™ (didanosine/ddI), HIVID™ (zalcitabine/ddC), ZERIT™ (stavudine/d4T), EPIVIR™ (lamivudine/3TC), and COMBIVIR™ (zidovudine/lamivudine). NNRTIs that may be administered in combination with the Therapeutics of the invention, include, but are not limited to, VIRAMUNE™ (nevirapine), RESCRIPTOR™ (delavirdine), and SUSTIVA™ (efavirenz). Protease inhibitors that may be administered in combination with the Therapeutics of the invention, include, but are not limited to, CRIXIVAN™ (indinavir), NORVIR™ (ritonavir), INVIRASE™ (saquinavir), and VIRACEPT™ (nelfinavir). In a specific embodiment, antiretroviral agents, nucleoside reverse transcriptase inhibitors, non-nucleoside reverse transcriptase inhibitors, and/or protease inhibitors may be used in any combination with therapeutics of the invention to treat AIDS and/or to prevent or treat HIV infection.

In a specific embodiment, compositions of the invention are administered in combination with a chemotherapeutic agent. Chemotherapeutic agents that may be administered with the compositions of the invention include, but are not limited to, antibiotic derivatives (e.g., doxorubicin (adriamycin), bleomycin, daunorubicin, and dactinomycin); antiestrogens (e.g., tamoxifen); antimetabolites (e.g., fluorouracil, 5-FU, methotrexate, floxuridine, interferon alpha-2b, glutamic acid, plicamycin, mercaptopurine, and 6-thioguanine); cytotoxic agents (e.g., cannustine, BCNU, lomustine, CCNU, cytosine arabinoside, cyclophosphamide, estramustine, hydroxyurea, procarbazine, mitomycin, busulfan, cisplatin, and vincristine sulfate); hormones (e.g., medroxyprogesterone, estramustine phosphate sodium, ethinyl estradiol, estradiol, megestrol acetate, methyltestosterone, diethylstilbestrol diphosphate, chlorotrianisene, and testolactone); nitrogen mustard derivatives (e.g., mephalen, chorambucil, mechlorethamine (nitrogen mustard) and thiotepa); steroids and combinations (e.g., bethamethasone sodium phosphate); and others (e.g., dicarbazine, asparaginase, mitotane, vincristine sulfate, vinblastine sulfate, etoposide, Topotecan, 5-Fluorouracil, paclitaxel (TAXOL™), Cisplatin, Cytarabine, and IFN-gamma, irinotecan (CAMPTOSAR™, CPT-11), irinotecan analogs, and gemcitabine (GEMZAR™)).

In a specific embodiment, antibody and antibody compositions of the invention are administered in combination with CHOP (cyclophosphamide, doxorubicin, vincristine, and prednisone) or any combination of the components of CHOP. In another embodiment, antibody and antibody compositions of the invention are administered in combination with Rituximab. In a further embodiment, antibody and antibody compositions of the invention are administered with Rituximab and CHOP, or Rituximab and any combination of the components of CHOP.

In additional preferred embodiments, the compositions of the invention are administered in combination with TRAIL polypeptides or fragments or variants thereof, particularly of the extracellular soluble domain of TRAIL.

In one embodiment, the compositions of the invention are administered in combination with other members of the TNF family or antibodies specific for TNF receptor family members. In specific embodiments, antibodies and antibody compositions of the invention are administered in combination with anti-TNF-alpha and/or anti-IL-1Beta antibodies. TNF, TNF-related or TNF-like molecules that may be administered with the compositions of the invention include, but are not limited to, soluble forms of TNF-alpha, lymphotoxin-alpha (LT-alpha, also known as TNF-beta), LT-beta (found in complex heterotrimer LT-alpha2-beta), OPGL, FasL, CD27L, CD30L, CD40L, 4-1BBL, DcR3, OX40L, TNF-gamma (International Publication No. WO 96/14328), TRAIL, AIM-II (International Publication No. WO 97/34911), APRIL (*J Exp Med* 188(6):1185-1190), endokine-alpha (International Publication No. WO 98/07880), TR6 (International Publication No. WO 98/30694), OPG, and neutrokine-alpha (International Publication No. WO 98/18921, OX40, and nerve growth factor (NGF), and soluble forms of Fas, CD30, CD27, CD40 and 4-IBB, TR2 (International Publication No. WO 96/34095), DR3 (International Publication No. WO 97/35904), TR5 (International Publication No. WO 98/30693), TR6 (International Publication No. WO 98/30694), TR7 (International Publication No. WO 98/41629), TRANK, TR9 (International Publication No. WO 98/56892), TR10 (International Publication No. WO 98/54202), 312C2 (International Publication No. WO 98/06842), and TR12, and soluble forms CD154, CD70, and CD153.

In a more preferred embodiment, the antibody and antibody compositions of the invention are administered in combination with an antimalarial, methotrexate, anti-TNF antibody, ENBREL™ and/or sulfasalazine. In one embodiment, the antibody and antibody compositions of the invention are administered in combination with methotrexate. In another embodiment, the antibody and antibody compositions of the invention are administered in combination with anti-TNF antibody. In another embodiment, the antibody and antibody compositions of the invention are administered in combination with methotrexate and anti-TNF antibody. In another embodiment, the antibody and antibody compositions of the invention are administered in combination with suflasalazine. In another specific embodiment, the antibody and antibody compositions of the invention are administered in combination with methotrexate, anti-TNF antibody, and sulfasalazine. In another embodiment, the antibody and antibody compositions of the invention are administered in combination ENBREL™. In another embodiment, the antibody and antibody compositions of the invention are administered in combination with ENBREL™ and methotrexate. In another embodiment, the antibody and antibody compositions of the invention are administered in combination with ENBREL™, methotrexate and sulfasalazine. In another embodiment, the antibody and antibody compositions of the invention are administered in combination with ENBREL™, methotrexate and sulfasalazine. In other embodiments, one or more antimalarials is combined with one of the above-recited combinations. In a specific embodiment, the antibody and antibody compositions of the invention are administered in combination with an antimalarial (e.g., hydroxychloroquine), ENBREL™, methotrexate and sulfasalazine. In another specific embodiment, the antibody and antibody compositions of the invention are administered in combination with an antimalarial (e.g., hydroxychloroquine), sulfasalazine, anti-TNF antibody, and methotrexate.

Conventional nonspecific immunosuppressive agents, that may be administered in combination with the antibody and antibody compositions of the invention include, but are not limited to, steroids, cyclosporine, cyclosporine analogs cyclophosphamide, cyclophosphamide IV, methylprednisolone, prednisolone, azathioprine, FK-506, 15-deoxyspergualin, and other immunosuppressive agents that act by suppressing the function of responding T cells.

In specific embodiments, antibody and antibody compositions of the invention are administered in combination with immunosuppressants. Immunosuppressants preparations that may be administered with the antibody and antibody compositions of the invention include, but are not limited to, ORTHOCLONE™ (OKT3), SANDIMMUNE™/NEORAL™/SANGDYA™ (cyclosporin), PROGRAF™ (tacrolimus), CELLCEPT™ (mycophenolate), Azathioprine, glucorticosteroids, and RAPAMUNE™ (sirolimus). In a specific embodiment, immunosuppressants may be used to prevent rejection of organ or bone marrow transplantation.

In a preferred embodiment, the antibody and antibody compositions of the invention are administered in combination with steroid therapy. Steroids that may be administered in combination with the antibody and antibody compositions of the invention, include, but are not limited to, oral corticosteroids, prednisone, and methylprednisolone (e.g., IV methylprednisolone). In a specific embodiment, antibody and antibody compositions of the invention are administered in combination with prednisone. In a further specific embodiment, the antibody and antibody compositions of the invention are administered in combination with prednisone and an immunosuppressive agent. Immunosuppressive agents that may be administered with the antibody and antibody compositions of the invention and prednisone are those described herein, and include, but are not limited to, azathioprine, cylophosphamide, and cyclophosphamide IV. In another specific embodiment, antibody and antibody compositions of the invention are administered in combination with methylprednisolone. In a further specific embodiment, the antibody and antibody compositions of the invention are administered in combination with methylprednisolone and an immunosuppressive agent. Immunosuppressive agents that may be administered with the antibody and antibody compositions of the invention and methylprednisolone are those described herein, and include, but are not limited to, azathioprine, cylophosphamide, and cyclophosphamide IV.

The invention also encompasses combining the antibodies of the invention with other proposed or conventional hematopoietic therapies. Thus, for example, antibodies of the invention can be combined with compounds that singly exhibit erythropoietic stimulatory effects, such as erythropoietin, testosterone, progenitor cell stimulators, insulin-like growth factor, prostaglandins, serotonin, cyclic AMP, prolactin, and triiodothyzonine. Also encompassed are combinations of the antibody and antibody compositions of the invention with compounds generally used to treat aplastic anemia, such as, for example, methenolene, stanozolol, and nandrolone; to treat iron-deficiency anemia, such as, for example, iron preparations; to treat malignant anemia, such as, for example, vitamin $B_{12}$ and/or folic acid; and to treat hemolytic anemia, such as, for example, adrenocortical steroids, eg., corticoids. See e.g., Resegotti et al., Panminerva Medica, 23:243-248 (1981); Kurtz, FEBS Letters, 14a:105-108 (1982); McGonigle et al., Kidney Int, 25:437-444 (1984); and Pavlovic-Kantera, Expt Hematol, 8(supp. 8) 283-291 (1980), the contents of each of which are hereby incorporated by reference in their entireties.

Compounds that enhance the effects of or synergize with erythropoietin are also useful as adjuvants herein, and include but are not limited to, adrenergic agonists, thyroid hormones, androgens, hepatic erythropoietic factors, erythrotropins, and erythrogenins, See e.g., Dunn, "Current Concepts in Erythropoiesis", John Wiley and Sons (Chichester, England, 1983); Kalmani, Kidney Int, 22:383-391 (1982); Shahidi, New Eng J Med 289:72-80 (1973); Urabe et al., J Exp Med 149:1314-1325 (1979); Billat et al., Expt Hematol 10:135-140 (1982); Naughton et al., Acta Haemat 69:171-179 (1983); Cognote et al. in abstract 364, Proceedings 7th Intl. Congress Endocrinol (Quebec City, Quebec, Jul. 1-7, 1984); and Rothman et al., J Surg Oncol 20:105-108 (1982). Methods for stimulating hematopoiesis comprise administering a hematopoietically effective amount (i.e., an amount which effects the formation of blood cells) of a pharmaceutical composition containing polynucleotides and/or polypeptides of the invention to a patient. The antibodies of the invention are administered to the patient by any suitable technique, including but not limited to, parenteral, sublingual, topical, intrapulmonary and intranasal, and those techniques further discussed herein. The pharmaceutical composition optionally contains one or more members of the group consisting of erythropoietin, testosterone, progenitor cell stimulators, insulin-like growth factor, prostaglandins, serotonin, cyclic AMP, prolactin, triiodothyzonine, methenolene, stanozolol, and nandrolone, iron preparations, vitamin $B_{12}$, folic acid and/or adrenocortical steroids.

In an additional embodiment, the antibody and antibody compositions of the invention are administered in combination with hematopoietic growth factors. Hematopoietic growth factors that may be administered with the antibody and antibody compositions of the invention include, but are not limited to, LEUKINE™ (SARGRAMOSTIM™) and NEUPOGEN™ (FILGRASTIM™).

In an additional embodiment, the antibody and antibody compositions of the invention are administered alone or in combination with an anti-angiogenic agent(s). Anti-angiogenic agents that may be administered with the antibody and antibody compositions of the invention include, but are not limited to, Angiostatin (ENTREMED™, Rockville, Md.), Troponin-1 (Boston Life Sciences, Boston, Mass.), anti-Invasive Factor, retinoic acid and derivatives thereof, paclitaxel (TAXOL™), Suramin, Tissue Inhibitor of Metalloproteinase-1, Tissue Inhibitor of Metalloproteinase-2, VEGI, Plasminogen Activator Inhibitor-1, Plasminogen Activator Inhibitor-2, and various forms of the lighter "d group" transition metals.

Lighter "d group" transition metals include, for example, vanadium, molybdenum, tungsten, titanium, niobium, and tantalum species. Such transition metal species may form transition metal complexes. Suitable complexes of the above-mentioned transition metal species include oxo transition metal complexes.

Representative examples of vanadium complexes include oxo vanadium complexes such as vanadate and vanadyl complexes. Suitable vanadate complexes include metavanadate and orthovanadate complexes such as, for example, ammonium metavanadate, sodium metavanadate, and sodium orthovanadate. Suitable vanadyl complexes include, for example, vanadyl acetylacetonate and vanadyl sulfate including vanadyl sulfate hydrates such as vanadyl sulfate mono- and trihydrates.

Representative examples of tungsten and molybdenum complexes also include oxo complexes. Suitable oxo tungsten complexes include tungstate and tungsten oxide complexes. Suitable tungstate complexes include ammonium tungstate, calcium tungstate, sodium tungstate dihydrate, and tungstic acid. Suitable tungsten oxides include tungsten (IV) oxide and tungsten (VI) oxide. Suitable oxo molybdenum complexes include molybdate, molybdenum oxide, and molybdenyl complexes. Suitable molybdate complexes include ammonium molybdate and its hydrates, sodium molybdate and its hydrates, and potassium molybdate and its hydrates. Suitable molybdenum oxides include molybdenum (VI) oxide, molybdenum (VI) oxide, and molybdic acid. Suitable molybdenyl complexes include, for example, molybdenyl acetylacetonate. Other suitable tungsten and molybdenum complexes include hydroxo derivatives derived from, for example, glycerol, tartaric acid, and sugars.

A wide variety of other anti-angiogenic factors may also be utilized within the context of the present invention. Representative examples include, but are not limited to, platelet factor 4; protamine sulphate; sulphated chitin derivatives (prepared from queen crab shells), (Murata et al., *Cancer Res* 51:22-26, 1991); Sulphated Polysaccharide Peptidoglycan Complex (SP-PG) (the function of this compound may be enhanced by the presence of steroids such as estrogen, and tamoxifen citrate); Staurosporine; modulators of matrix metabolism, including for example, proline analogs, cishydroxyproline, d,L-3,4-dehydroproline, Thiaproline, alpha, alpha-dipyridyl, aminopropionitrile fumarate; 4-propyl-5-(4-pyridinyl)-2(3H)-oxazolone; Methotrexate; Mitoxantrone; Heparin; Interferons; 2 Macroglobulin-serum; ChIMP-3 (Pavloff et al., *J Biol Chem* 267:17321-17326, 1992); Chymostatin (Tomkinson et al., *Biochem J* 286:475-480, 1992); Cyclodextrin Tetradecasulfate; Eponemycin; Camptothecin; Fumagillin (Ingber et al., *Nature* 348:555-557, 1990); Gold Sodium Thiomalate ("GST"; Matsubara and Ziff, *J Clin Invest* 79:1440-1446, 1987); and collagenase-serum; alpha2-antiplasmin (Holmes et al., *J Biol Chem* 262(4):1659-1664, 1987); Bisantrene (National Cancer Institute); Lobenzarit disodium (N-(2)-carboxyphenyl-4-chloroanthronilic acid disodium or "CCA"; (Takeuchi et al., *Agents Actions* 36:312-316, 1992); and metalloproteinase inhibitors such as BB94.

Additional anti-angiogenic factors that may also be utilized within the context of the present invention include Thalidomide, (CELGENE™, Warren, N.J.); Angiostatic steroid; AGM-1470 (H. Brem and J. Folkman *J Pediatr Surg* 28:445-51 (1993)); an integrin alpha v beta 3 antagonist (Storgard et al., *J Clin Invest* 103:47-54 (1999)); carboxynaminolmidazole; Carboxyamidotriazole (CAI) (National Cancer Institute, Bethesda, Md.); Conbretastatin A4 (CA4P) (OXIGENE™, Boston, Mass.); Squalamine (Magainin Pharmaceuticals, Plymouth Meeting, Pa.); TNP470, (TAP PHARMACEUTICALS™, Deerfield, Ill.); ZD-0101 ASTRAZENECA™ (London, UK); APRA (CT2584); Benefin, Byrostatin-1 (SC359555); CGP41251 (PKC 412); CM101; Dexrazoxane (ICRF187); DMXAA; Endostatin; Flavopridiol; Genestein; GTE; ImmTher; Iressa (ZD1839); Octreotide (Somatostatin); Panretin; Penacillamine; Photopoint; PI-88; Prinomastat (AG-3540) Purlytin; Suradista (FCE26644); Tamoxifen (NOLVADEX™); Tazarotene; Tetrathiomolybdate; XELODA™ (Capecitabine); and 5-Fluorouracil.

Anti-angiogenic agents that may be administered in combination with the compounds of the invention may work through a variety of mechanisms including, but not limited to, inhibiting proteolysis of the extracellular matrix, blocking the function of endothelial cell-extracellular matrix adhesion molecules, by antagonizing the function of angiogenesis inducers such as growth factors, and inhibiting integrin receptors expressed on proliferating endothelial cells. Examples of anti-angiogenic inhibitors that interfere with extracellular matrix proteolysis and which may be administered in combination with the antibody and antibody compositions of the invention include, but are not limited to, AG-3540 (AGOURON™, La Jolla, Calif.), BAY-12-9566 (BAYER™, West Haven, Conn.), BMS-275291 (Bristol Myers Squibb, Princeton, N.J.), CGS-27032A (NOVARTIS™, East Hanover, N.J.), Marimastat (British Biotech, Oxford, UK), and METASTAT™ (AETERNA™, St-Foy, Quebec). Examples of anti-angiogenic inhibitors that act by blocking the function of endothelial cell-extracellular matrix adhesion molecules and which may be administered in combination with the antibody and antibody compositions of the invention include, but are not limited to, EMD-121974 (MERCK™ KcgaA Darmstadt, Germany) and VITAXIN™ (IXSYS™, La Jolla, Calif./MEDIMMUNE™, Gaithersburg, Md.). Examples of anti-angiogenic agents that act by directly antagonizing or inhibiting angiogenesis inducers and which may be administered in combination with the antibody and antibody compositions of the invention include, but are not limited to, Angiozyme (Ribozyme, Boulder, Colo.), Anti-VEGF antibody (GENENTECH™, South San Francisco, Calif.), PTK-787/ZK-225846 (NOVARTIS™, Basel, Switzerland), SU-101 (SUGEN™, South San Francisco, Calif.), SU-5416 (SUGEN™/PHARMACIA™ Upjohn, Bridgewater, N.J.), and SU-6668 (SUGEN™). Other anti-angiogenic agents act to indirectly inhibit angiogenesis. Examples of indirect inhibitors of angiogenesis which may be administered in combination with the antibody and antibody compositions of the invention include, but are not limited to, IM-862 (CYTRAN™, Kirkland, Wash.), Interferon-alpha, IL-12 (Roche, Nutley, N.J.), and Pentosan polysulfate (Georgetown University, Washington, D.C.).

In particular embodiments, the use of antibody and antibody compositions of the invention in combination with anti-angiogenic agents is contemplated for the treatment, prevention, and/or amelioration of cancers and other hyperproliferative disorders.

In a preferred embodiment, the antibody and antibody compositions of the invention are administered in combination with CD40 ligand (CD40L), a soluble form of CD40L (e.g., AVREND™), biologically active fragments, variants, or derivatives of CD40L, anti-CD40L antibodies (e.g., agonistic or antagonistic antibodies), and/or anti-CD40 antibodies (e.g., agonistic or antagonistic antibodies).

In another embodiment, antibody and antibody compositions of the invention are administered in combination with an anticoagulant. Anticoagulants that may be administered with the antibody and antibody compositions of the invention include, but are not limited to, heparin, warfarin, and aspirin. In a specific embodiment, antibody and antibody compositions of the invention are administered in combination with heparin and/or warfarin. In another specific embodiment, antibody and antibody compositions of the invention are administered in combination with warfarin. In another specific embodiment, antibody and antibody compositions of the invention are administered in combination with warfarin and aspirin. In another specific embodiment, antibody and antibody compositions of the invention are administered in combination with heparin. In another specific embodiment, antibody and antibody compositions of the invention are administered in combination with heparin and aspirin.

In another embodiment, antibody and antibody compositions of the invention are administered in combination with an agent that suppresses the production of anti-cardiolipin antibodies. In specific embodiments, the antibodies of the invention are administered in combination with an agent that blocks and/or reduces the ability of ant-cardiolipin antibodies to bind phospholipid-binding plasma protein beta 2-glycoprotein I (b2GPI).

In a preferred embodiment, the antibody and antibody compositions of the invention are administered in combination with an antimalarial. Antimalarials that may be administered with the antibody and antibody compositions of the invention include, but are not limited to, hydroxychloroquine, chloroquine, and/or quinacrine.

In a preferred embodiment, the antibody and antibody compositions of the invention are administered in combination with an NSAID.

In a nonexclusive embodiment, the antibody and antibody compositions of the invention are administered in combination with one, two, three, four, five, ten, or more of the following drugs: NRD-101 (HOECHST MARION ROUSSEL™), diclofenac (Dimethaid), oxaprozin potassium (Monsanto), mecasermin (CHIRON™), T-714 (TOYAMA™), pemetrexed disodium (ELI LILLY™), atreleuton (ABBOTT™), valdecoxib (Monsanto), eltenac (Byk Gulden), CAMPATH™, AGM-1470 (TAKEDA™), CDP-571 (CELLTECH CHIROSCIENCE™), CM-101 (CarboMed), ML-3000 (Merckle), CB-2431 (KS Biomedix), CBF-BS2 (KS Biomedix), IL-IRa gene therapy (VALENTIS™), JTE-522 (JAPAN TOBACCO™), paclitaxel (ANGIOTECH™), DW-166HC (Dong Wha), darbufelone mesylate (WARNER-LAMBERT™), soluble TNF receptor 1 (SYNERGEN™; AMGEN™), IPR-6001 (Institute for Pharmaceutical Research), trocade (HOFFMAN-LA ROCHE™), EF-5 (SCOTIA PHARMACEUTICALS™), BIIL-284 (BOEHRINGER INGELHEIM™), BIIF-1149 (BOEHRINGER INGELHEIM™), LEUKOVAX™ (INFLAMMATICS™), MK-671 (MERCK™), ST-1482 (Sigma-Tau), and butixocort propionate (WARNER-LAMBERT™).

In a preferred embodiment, the antibody and antibody compositions of the invention are administered in combination with one, two, three, four, five or more of the following drugs: methotrexate, sulfasalazine, sodium aurothiomalate, auranofin, cyclosporine, penicillamine, azathioprine, an antimalarial drug (e.g., as described herein), cyclophosphamide, chlorambucil, gold, ENBREL™ (Etanercept), anti-TNF antibody, LJP 394 (LA JOLLA PHARMACEUTICAL COMPANY™, San Diego, Calif.) and prednisolone.

In an additional embodiment, antibody and antibody compositions of the invention are administered alone or in combination with one or more intravenous immune globulin preparations. Intravenous immune globulin preparations that may be administered with the antibody and antibody compositions of the invention include, but are not limited to, GAMMAR™, IVEEGAM™, SANDOGLOBULIN™, GAMMA-GARD S/D™, and GAMIMUNE™. In a specific embodiment, antibody and antibody compositions of the invention are administered in combination with intravenous immune globulin preparations in transplantation therapy (e.g., bone marrow transplant).

In an additional embodiment, the antibody and antibody compositions of the invention are administered in combination with cytokines. Cytokines that may be administered with the antibody and antibody compositions of the invention include, but are not limited to, GM-CSF, G-CSF, IL2, IL3, IL4, IL5, IL6, IL7, IL10, IL12, IL13, IL15, anti-CD40, CD40L, IFN-alpha, IFN-beta, IFN-gamma, TNF-alpha, and TNF-beta. In preferred embodiments, antibody and antibody compositions of the invention are administered with TRAIL receptor. In another embodiment, antibody and antibody compositions of the invention may be administered with any interleukin, including, but not limited to, IL-1alpha, IL-1beta, IL-2, IL-3, IL-4, IL-5, IL-6, IL-7, IL-8, IL-9, IL-10, IL-11, IL-12, IL-13, IL-14, IL-15, IL-16, IL-17, IL-18, IL-19, IL-20, IL-21, and IL-22. In preferred embodiments, the antibody and antibody compositions of the invention are administered in combination with IL4 and IL10.

In one embodiment, the antibody and antibody compositions of the invention are administered in combination with one or more chemokines. In specific embodiments, the antibody and antibody compositions of the invention are administered in combination with an $\alpha(C \times C)$ chemokine selected from the group consisting of gamma-interferon inducible protein-10 ($\gamma$IP-10), interleukin-8 (IL-8), platelet factor-4 (PF4), neutrophil activating protein (NAP-2), GRO-$\alpha$, GRO-$\beta$, GRO-$\gamma$, neutrophil-activating peptide (ENA-78), granulocyte chemoattractant protein-2 (GCP-2), and stromal cell-derived factor-1 (SDF-1, or pre-B cell stimulatory factor (PBSF)); and/or a $\beta(CC)$ chemokine selected from the group consisting of: RANTES (regulated on activation, normal T expressed and secreted), macrophage inflammatory protein-1 alpha (MIP-1$\alpha$), macrophage inflammatory protein-1 beta (MIP-1$\beta$), monocyte chemotactic protein-1 (MCP-1), monocyte chemotactic protein-2 (MCP-2), monocyte chemotactic protein-3 (MCP-3), monocyte chemotactic protein-4 (MCP-4) macrophage inflammatory protein-1 gamma (MIP-1$\gamma$), macrophage inflammatory protein-3 alpha (MIP-3$\alpha$), macrophage inflammatory protein-3 beta (MIP-3$\beta$), macrophage inflammatory protein-4 (MIP-4/DC-CK-1/PARC), eotaxin, Exodus, and 1-309; and/or the $\gamma(C)$ chemokine, lymphotactin.

In another embodiment, the antibody and antibody compositions of the invention are administered with chemokine beta-8, chemokine beta-1, and/or macrophage inflammatory protein-4. In a preferred embodiment, the antibody and antibody compositions of the invention are administered with chemokine beta-8.

In an additional embodiment, the antibody and antibody compositions of the invention are administered in combination with an IL-4 antagonist. IL-4 antagonists that may be administered with the antibody and antibody compositions of the invention include, but are not limited to: soluble IL-4 receptor polypeptides, multimeric forms of soluble IL-4 receptor polypeptides; anti-IL-4 receptor antibodies that bind the IL-4 receptor without transducing the biological signal elicited by IL-4, anti-IL4 antibodies that block binding of IL-4 to one or more IL-4 receptors, and muteins of IL-4 that bind IL-4 receptors but do not transduce the biological signal elicited by IL-4. Preferably, the antibodies employed according to this method are monoclonal antibodies (including antibody fragments, such as, for example, those described herein).

In an additional embodiment, the antibody and antibody compositions of the invention are administered in combination with fibroblast growth factors. Fibroblast growth factors that may be administered with the antibody and antibody compositions of the invention include, but are not limited to, FGF-1, FGF-2, FGF-3, FGF-4, FGF-5, FGF-6, FGF-7, FGF-8, FGF-9, FGF-10, FGF-11, FGF-12, FGF-13, FGF-14, and FGF-15.

Demonstration of Therapeutic or Prophylactic Utility of a Composition

The compounds of the invention are preferably tested in vitro, and then in vivo for the desired therapeutic or prophylactic activity, prior to use in humans. For example, in vitro assays which can be used to determine whether administration of a specific antibody or composition of the present invention is indicated, include in vitro cell culture assays in which a patient tissue sample is grown in culture, and exposed to or otherwise administered an antibody or composition of the present invention, and the effect of such an antibody or composition of the present invention upon the tissue sample is observed. In various specific embodiments, in vitro assays can be carried out with representative cells of cell types involved in a patient's disorder, to determine if an antibody or composition of the present invention has a desired effect upon such cell types. Preferably, the antibodies or compositions of the invention are also tested in in vitro assays and animal model systems prior to administration to humans.

Antibodies or compositions of the present invention for use in therapy can be tested for their toxicity in suitable animal model systems, including but not limited to rats, mice, chicken, cows, monkeys, and rabbits. For in vivo testing of an antibody or composition's toxicity, any animal model system known in the art may be used.

Antibodies or compositions of the invention can also be tested for their ability to promote neurite or axon outgrowth in in vitro and in vivo assays known to those of skill in the art. Antibodies or compositions of the invention can also be tested for their ability to traverse a glial scar associated with spinal cord injury or brain trauma. Antibodies or antibody compositions of the invention can also be tested for their ability to ameliorate symptoms associated with stroke. Further, antibodies or compositions of the invention can be tested for their ability to induce apoptotic cell death. Techniques known to those of skill in the art can be used to analyze the function of the antibodies or compositions of the invention in vivo.

Panels/Mixtures

The present invention also provides for mixtures of antibodies (including scFvs and other molecules comprising, or alternatively consisting of, antibody fragments or variants thereof) that specifically bind to NogoR or a fragment or variant thereof, wherein the mixture has at least one, two, three, four, five or more different antibodies of the invention. In specific embodiments, the invention provides mixtures of at least 2, preferably at least 4, at least 6, at least 8, at least 10, at least 12, at least 15, at least 20, or at least 25 different antibodies that specifically bind to NogoR or fragments or variants thereof, wherein at least 1, at least 2, at least 4, at least 6, or at least 10, antibodies of the mixture is an antibody of the invention. In a specific embodiment, each antibody of the mixture is an antibody of the invention.

The present invention also provides for panels of antibodies (including scFvs and other molecules comprising, or alternatively consisting of, antibody fragments or variants thereof) that specifically bind to NogoR or a fragment or variant thereof, wherein the panel has at least one, two, three, four, five or more different antibodies of the invention. In specific embodiments, the invention provides for panels of antibodies that have different affinities for NogoR, different specificities for NogoR, or different dissociation rates. The invention provides panels of at least 10, preferably at least 25, at least 50, at least 75, at least 100, at least 125, at least 150, at least 175, at least 200, at least 250, at least 300, at least 350, at least 400, at least 450, at least 500, at least 550, at least 600, at least 650, at least 700, at least 750, at least 800, at least 850, at least 900, at least 950, or at least 1000, antibodies. Panels of antibodies can be used, for example, in 96 well plates for assays such as ELISAs.

The present invention further provides for compositions comprising, one or more antibodies (including molecules comprising, or alternatively consisting of antibody fragments or variants of the invention). In one embodiment, a composition of the present invention comprises, one, two, three, four, five, or more antibodies that comprise or alternatively consist of, a polypeptide having an amino acid sequence of any one or more of the VH domains of a one or more of the scFvs referred to in Table 1, or a variant thereof. In another embodiment, a composition of the present invention comprises, one, two, three, four, five, or more antibodies that comprise, or alternatively consist of, a polypeptide having an amino acid sequence of any one or more of the VH CDR1s of a VH domain of one or more of the scFvs referred to in Table 1, or a variant thereof. In another embodiment, a composition of the present invention comprises, one, two, three, four, five or more antibodies that comprise, or alternatively consist of, a polypeptide having an amino acid sequence of any one or more of the VH CDR2s of a VH domain of one or more of the scFvs referred to in Table 1, or a variant thereof. In a preferred embodiment, a composition of the present invention comprises, one, two, three, four, five, or more antibodies that comprise, or alternatively consist of, a polypeptide having an amino acid sequence of any one or more of the VH CDR3s as of a VH domain of one or more of the scFvs referred to in Table 1, or a variant thereof.

Other embodiments of the present invention providing for compositions comprising, one or more antibodies (including molecules comprising, or alternatively consisting of antibody fragments or variants of the invention) are listed below. In another embodiment, a composition of the present invention comprises, one, two, three, four, five, or more antibodies that comprise, or alternative consist of, a polypeptide having an amino acid sequence of any one or more of the VL domains of one or more of the scFvs referred to in Table 1, or a variant thereof. In another embodiment, a composition of the present invention comprises, one, two, three, four, five, or more antibodies that comprise, or alternatively consist of, a polypeptide having an amino acid sequence of any one or more of the VL CDR1s domains of one or more of the scFvs referred to in Table 1, or a variant thereof. In another embodiment, a composition of the present invention comprises, one, two, three, four, five, or more antibodies that comprise, or alternatively consist of, a polypeptide having an amino acid sequence of any one or more of the VL CDR2s of one or more of the scFvs referred to in Table 1, or a variant thereof. In a preferred embodiment, a composition of the present invention comprises, one, two, three, four, five, or more antibodies that comprise, or alternatively consist of, a polypeptide having an amino acid sequence of any one or more of the VL CDR3s domains of one or more of the scFvs referred to in Table 1, or a variant thereof.

Kits

The invention also provides a pharmaceutical pack or kit comprising one or more containers filled with one or more of the ingredients of the pharmaceutical compositions of the invention. Optionally associated with such container(s) can be a notice in the form prescribed by a governmental agency regulating the manufacture, use or sale of pharmaceuticals or biological products, which notice reflects approval by the agency of manufacture, use or sale for human administration.

The present invention provides kits that can be used in the above methods. In one embodiment, a kit comprises an antibody of the invention, preferably a purified antibody, in one or more containers. In an alterative embodiment, a kit comprises an antibody fragment that specifically binds to NogoR or fragments or variants thereof. In a specific embodiment, the kits of the present invention contain a substantially isolated NogoR or fragment or variant thereof as a control. Preferably, the kits of the present invention further comprise a control antibody which does not react with NogoR or fragments or variants thereof. In another specific embodiment, the kits of the present invention contain a means for detecting the binding of an antibody to NogoR (e.g., the antibody may be conjugated to a detectable substrate such as a fluorescent compound, an enzymatic substrate, a radioactive compound or a luminescent compound, or a second antibody which recognizes the first antibody may be conjugated to a detectable substrate). In specific embodiments, the kit may include a recombinantly produced or chemically synthesized NogoR polypeptide. The NogoR provided in the kit may also be attached to a solid support. In a more specific embodiment the detecting means of the above-described kit includes a solid support to which NogoR is attached. Such a kit may also include a non-attached reporter-labeled anti-human antibody. In this embodiment, binding of the antibody to NogoR can be detected by binding of the said reporter-labeled antibody.

Gene Therapy

In a specific embodiment, nucleic acids comprising sequences encoding antibodies or functional derivatives thereof, are administered to treat and/or ameliorate spinal cord injuries, by way of gene therapy. Gene therapy refers to therapy performed by the administration to a subject of an expressed or expressible nucleic acid. In this embodiment of the invention, the nucleic acids produce their encoded protein that mediates a therapeutic effect.

Any of the methods for gene therapy available in the art can be used according to the present invention. Exemplary methods are described below.

For general reviews of the methods of gene therapy, see Goldspiel et al., *Clin Pharm* 12:488-505 (1993); Wu and Wu, *Biotherapy* 3:87-95 (1991); Tolstoshev, *Ann Rev Pharmacol Toxicol* 32:573-596 (1993); Mulligan, *Science* 260:926-932 (1993); and Morgan and Anderson, *Ann Rev Biochem* 62:191-217 (1993); May, *TIBTECH* 11(5):155-215 (1993). Methods commonly known in the art of recombinant DNA technology which can be used are described in Ausubel et al. (eds.), Current Protocols in Molecular Biology, John Wiley & Sons, NY (1993); and Kriegler, Gene Transfer and Expression, A Laboratory Manual, Stockton Press, NY (1990).

In a preferred aspect, a composition of the invention comprises, or alternatively consists of, nucleic acids encoding an antibody, said nucleic acids being part of an expression vector that expresses the antibody or fragments or chimeric proteins or heavy or light chains thereof in a suitable host. In particular, such nucleic acids have promoters, preferably heterologous promoters, operably linked to the antibody coding region, said promoter being inducible or constitutive, and, optionally, tissue-specific. In another particular embodiment, nucleic acid molecules are used in which the antibody coding sequences and any other desired sequences are flanked by regions that promote homologous recombination at a desired site in the genome, thus providing for intrachromosomal expression of the antibody encoding nucleic acids (Koller and Smithies, *Proc Natl Acad Sci USA* 86:8932-8935 (1989); Zijlstra et al., *Nature* 342:435-438 (1989). In specific embodiments, the expressed antibody molecule is an scFv; alternatively, the nucleic acid sequences include sequences encoding both the heavy and light chains, or fragments or variants thereof, of an antibody.

Delivery of the nucleic acids into a patient may be either direct, in which case the patient is directly exposed to the nucleic acid or nucleic acid-carrying vectors, or indirect, in which case, cells are first transformed with the nucleic acids in vitro, then transplanted into the patient. These two approaches are known, respectively, as in vivo or ex vivo gene therapy.

In a specific embodiment, the nucleic acid sequences are directly administered in vivo, where it is expressed to produce the encoded product. This can be accomplished by any of numerous methods known in the art, e.g., by constructing them as part of an appropriate nucleic acid expression vector and administering it so that they become intracellular, e.g., by infection using defective or attenuated retrovirals or other viral vectors (see U.S. Pat. No. 4,980,286), or by direct injection of naked DNA, or by use of microparticle bombardment (e.g., a gene gun; Biolistic, DUPONT™), or coating with lipids or cell-surface receptors or transfecting agents, encapsulation in liposomes, microparticles, or microcapsules, or by administering them in linkage to a peptide which is known to enter the nucleus, by administering it in linkage to a ligand subject to receptor-mediated endocytosis (see, e.g., Wu and Wu, *J Biol Chem* 262:4429-4432 (1987)) (which can be used to target cell types specifically expressing the receptors), etc. In another embodiment, nucleic acid-ligand complexes can be formed in which the ligand comprises a fusogenic viral peptide to disrupt endosomes, allowing the nucleic acid to avoid lysosomal degradation. In yet another embodiment, the nucleic acid can be targeted in vivo for cell specific uptake and expression, by targeting a specific receptor (see, e.g., PCT Publications WO 92/06180; WO 92/22715; WO92/20316; WO93/14188, WO 93/20221). Alternatively, the nucleic acid can be introduced intracellularly and incorporated within host cell DNA for expression, by homologous recombination (Koller and Smithies, *Proc Natl Acad Sci USA* 86:8932-8935 (1989); Zijistra et al., *Nature* 342:435-438 (1989)).

In a specific embodiment, viral vectors that contains nucleic acid sequences encoding an antibody of the invention or fragments or variants thereof are used. For example, a retroviral vector can be used (see Miller et al., *Meth Enzymol* 217:581-599 (1993)). These retroviral vectors contain the components necessary for the correct packaging of the viral genome and integration into the host cell DNA. The nucleic acid sequences encoding the antibody to be used in gene therapy are cloned into one or more vectors, which facilitates delivery of the gene into a patient. More detail about retroviral vectors can be found in Boesen et al., *Biotherapy* 6:29 1-302 (1994), which describes the use of a retroviral vector to deliver the mdr1 gene to hematopoictic stem cells in order to make the stem cells more resistant to chemotherapy. Other references illustrating the use of retroviral vectors in gene therapy are: Clowes et al., *J Clin Invest* 93:644-651(1994); Klein et al., *Blood* 83:1467-1473 (1994); Salmons and Gunzberg, *Human Gene Therapy* 4:129-141 (1993); and Grossman and Wilson, *Curr Opin Genetics Devel* 3:110-114 (1993).

Adenoviruses are other viral vectors that can be used in gene therapy. Adenoviruses are especially attractive vehicles for delivering genes to respiratory epithelia. Adenoviruses naturally infect respiratory epithelia where they cause a mild disease. Other targets for adenovirus-based delivery systems are liver, the CNS, endothelial cells, and muscle. Adenoviruses have the advantage of being capable of infecting non-dividing cells. Kozarsky and Wilson, *Curr Opin Genetics Devel* 3:499-503 (1993) present a review of adenovirus-based gene therapy. Bout et al., *Human Gene Therapy* 5:3-10 (1994) demonstrated the use of adenovirus vectors to transfer genes to the respiratory epithelia of rhesus monkeys. Other instances of the use of adenoviruses in gene therapy can be found in Rosenfeld et al., *Science* 252:431-434 (1991); Rosenfeld et al., *Cell* 68:143-155 (1992); Mastrangeli et al., *J Clin Invest* 91:225-234 (1993); PCT Publication WO94/12649; and Wang et al., *Gene Therapy* 2:775-783 (1995). In a preferred embodiment, adenovirus vectors are used.

Adeno-associated virus (AAV) has also been proposed for use in gene therapy (Walsh et al., *Proc Soc Exp Biol Med* 204:289-300 (1993); U.S. Pat. No. 5,436,146).

Another approach to gene therapy involves transferring a gene to cells in tissue culture by such methods as electroporation, lipofection, calcium phosphate mediated transfection, or viral infection. Usually, the method of transfer includes the transfer of a selectable marker to the cells. The cells are then placed under selection to isolate those cells that have taken up and are expressing the transferred gene. Those cells are then delivered to a patient.

In this embodiment, the nucleic acid is introduced into a cell prior to administration in vivo of the resulting recombinant cell. Such introduction can be carried out by any method known in the art, including but not limited to transfection, electroporation, microinjection, infection with a viral or bacteriophage vector containing the nucleic acid sequences, cell fusion, chromosome-mediated gene transfer, microcell-mediated gene transfer, spheroplast fusion, etc. Numerous techniques are known in the art for the introduction of foreign genes into cells (see, e.g., Loeffler and Behr, *Meth Enzymol* 217:599-718 (1993); Cohen et al., *Meth Enzymol* 217:718-644 (1993); *Clin Pharm Ther* 29:69-92 (1985)) and may be used in accordance with the present invention, provided that the necessary developmental and physiological functions of the recipient cells are not disrupted. The technique should provide for the stable transfer of the nucleic acid to the cell, so that the nucleic acid is expressible by the cell and preferably heritable and expressible by its cell progeny.

The resulting recombinant cells can be delivered to a patient by various methods known in the art. Recombinant blood cells (e.g., hematopoietic stem or progenitor cells) are preferably administered intravenously. The amount of cells envisioned for use depends on the desired effect, patient state, etc., and can be determined by one skilled in the art.

Cells into which a nucleic acid can be introduced for purposes of gene therapy encompass any desired, available cell type, and include but are not limited to epithelial cells, endothelial cells, keratinocytes, fibroblasts, muscle cells, hepatocytes; blood cells such as T lymphocytes, B lymphocytes, monocytes, macrophages, neutrophils, eosinophils, megakaryocytes, granulocytes; various stem or progenitor cells, in particular hematopoietic stem or progenitor cells, e.g., as obtained from bone marrow, umbilical cord blood, peripheral blood, fetal liver, etc.

In a preferred embodiment, the cell used for gene therapy is autologous to the patient.

In an embodiment in which recombinant cells are used in gene therapy, nucleic acid sequences encoding an antibody or fragment thereof are introduced into the cells such that they are expressible by the cells or their progeny, and the recombinant cells are then administered in vivo for therapeutic effect. In a specific embodiment, stem or progenitor cells are used. Any stem and/or progenitor cells which can be isolated and maintained in vitro can potentially be used in accordance with this embodiment of the present invention (see, e.g., PCT Publication WO 94/08598; Stemple and Anderson, *Cell* 71:973-985 (1992); Rheinwald, *Meth Cell Bio* 21A:229 (1980); and Pittelkow and Scott, *Mayo Clinic Proc* 71:771 (1986)).

In a specific embodiment, the nucleic acid to be introduced for purposes of gene therapy comprises an inducible promoter operably linked to the coding region, such that expression of the nucleic acid is controllable by controlling the presence or absence of the appropriate inducer of transcription.

EXAMPLES

Example 1

Isolation and Characterization of scFvs that Bind NogoR Referred to in Table 1

Recombinant soluble human Flag-tagged NogoR (amino acids 1 to 309 of SEQ ID NO:2) was expressed transiently in 293 cells and purified from the culture supernatnet by affinity chromatography on an anti-Flag column (SIGMA™ Sigma-Aldrich, St. Louis, Mo.) following the manufacturer's protocol. The purified soluble human Flag-tagged NogoR (rHuNOGOSR-Flag) was labeled with Sulfo-NHS-LC-Biotin (PIERCE™; Rockford, Ill.) at a molar challenge ratio of 3:1 in PBS, pH 8.0 for 60 minutes at 23° C. Protein was separated from free label using a NAP 5 gel filtration column (GE™ Healthcare, Amersham Biosciences Corp., Piscataway, N.J.) following manufacturer's protocol. Approximately $10^{13}$ TU of phage from phage display libraries available from Cambridge Antibody Technology (Cambridgshire, United Kingdom) diluted in 3% milk/PBS was added to an eppendorf tube followed by the addition of biotinylated rHuNOGOSR-Flag to final concentrations ranging from 5 to 25 nM. The phage plus antigen solution was incubated for at least 60 minutes at 23° C. with gentle mixing, after which 1 mg of Streptavidin coated magnetic beads (DYNAL™ DYNABEADS™ M280 magnetic beads; DYNAL™ Biotech, Brown Deer, Wis.) was added and incubation continued for an additional 30 minutes. The Streptavidin beads were pulled out of solution with a magnetic rack and the beads resuspended in 1 ml of PBST. This washing process was repeated a total of 8 times with PBST followed by two times with PBS. The beads were pelleted a final time and bound phage eluted by adding 100 microliters of 100 mM triethylamine with occasional vortexing, after which the solution is removed from the beads and immediately neutralized with 50 microliters of 1.0 M Tris-HCl, pH 7.4. A portion of the eluted phage are used to infect mid-log *E. coli* TG1 by incubating the phage with the bacteria for 60 minutes at 37° C. The *E. coli* were then plated on 2xTY plates containing 2% glucose and 100 micrograms/ml ampicillin. The phage were then rescued from the bacteria with delta gene 3 helper phage (M13K07) to prepare phage for a subsequent round of selection. This process is usually repeated for a total of 3 rounds of affinitiy purification. Specific enrichment of rHuNOGOSR-Flag binding phage from solution phase selections was monitored during the selection process using the assay protocol described below.

Soluble NogoR Binding Assay Protocol for scFv-Phage Library Screening

Purified full-length rHuNOGOSR-Flag was labeled with Sulfo-NHS-LC-Biotin (PIERCE™; Rockford, Ill.) as described above. A polyclonal antibody specific for the M13 phage coat (GE™ Healthcare, Amersham Biosciences Corp., Piscataway, N.J.) was labeled with the electrochemiluminescent reporter Origen-TAG-NHS (Ori-TAG=electrochemiluminescent reporter Origen-TAG-N HS) (available from BIOVERIS™ Corp., Gaithersburg, Md.) at a molar challenge ratio of 5:1 in PBS, pH 8.0 buffer for 60 minutes at 23° C. Protein was separated from free label using a NAP 5 gel filtration column (GE™ Healthcare, Amersham Biosciences Corp.) following manufacturer's protocol. The amount of incorporated Origen-TAG label was determined by measuring the absorbance of the undiluted labeling reaction at 455 nm in a 1 cm cuvette and dividing by 13,700 (extinction coefficient of Ori-TAG label) to obtain the Ori-TAG label concentration in moles per liter. This number was divided by the moles per liter IgG concentration in the labeling reaction. Label concentrations used in the assay ranged from 3 to 5 labels per IgG molecule. The biotinylated-rHuNOGOSR-Flag and Origen-TAG labeled anti-M13 antibody were used to screen phage clones for binding to rHuNOGOSR-Flag as described below.

Individual *E. coli* colonies containing phagemid were inoculated into 96 well plates containing 100 microliters 2×TY, 100 micrograms/ml ampicillin and 2% glucose per well. The plates were incubated at 37° C. for 4 hours while being shaken. M13K07 helper phage was added to each well at a multiplicity of infection (MOI) of 2 to 10 and the plates were incubated for another 1 hour at 37° C. The plates were centrifuged in a benchtop centrifuge at 3,500 rpm for 10 minutes. The supernatant was removed and cell pellets were resuspended in 100 microliters 2×TY, 100 micrograms/ml ampicillin, and 50 micrograms/ml kanamycin and incubated at 30° C. overnight, with vigorous shaking. The next day, the plates were centrifuged at 3,500 rpm for 10 minutes, and 100 microliters of phage-containing supernatant from each well was carefully transferred into a fresh 96-well plate.

The supernatants containing scFv-phage were screened for binding rHuNOGOSR-Flag using the following protocol: In a 96 well plate, 5 microliters of scFv-phage were combined with 150 microliters of 0.5 micrograms/ml Biotinylated-rHuNOGOSR-Flag and 0.5 micrograms/ml Origen-Tag labeled anti-M13 polyclonal antibody and 25 micrograms of Streptavidin coated magnetic beads (DYNAL™ DYNA-BEADS™ M280 magnetic beads. The plate was sealed and mixed vigorously for 60 minutes at room temperature. The electrochemiluminescent (ECL) signal was measured in each well of the plate using an Origen M8 series ECL analyzer (BIOVERIS™ Corp., Gaithersburg, Md.). Wells that showed ECL signals that were 5-fold above the assay background were scored as positive rHuNOGOSR-Flag binders and submitted for sequencing.

The complete nucleotide sequence of the scFv insert from 2,180 rHuNOGOSR-Flag positive binding phage clones was determined and a numerical summary of the sequence diversity (represented by group number) as well as a summary of the light and/or heavy chain CDR3 amino acid sequences are shown in Table 4. The complete sequences of the clones listed in Table 4 are given in the sequence listing of the present application. Table 1 lists the clone names and the corresponding SEQ ID NOs for both the amino acid sequence of the scFv and a nucleotide sequence that encodes the scFv.

TABLE 4

Summary of scFv Groups and CDR 3 Sequences for NogoR Binding Phage Clones Derived by Solid and Solution Phase Selections

| Group | Representative clone | HC CDR 3 Seq. | LC CDR 3 Seq. |
| --- | --- | --- | --- |
| 1 | NGE2005 | GLERHYVDV | NSRDSSGNHVV |
| 2 | NGE2077 | GPLVRYYFYYMDV | ASWDDSLNGRV |
| 3 | NGE2105 | EINDYGDFGGYDL | SSYTTRSTRV |
| 4 | NGE2122 | DRETVTTNWAYYFDY | STYAPPGIIM |
| 5 | NGE2902 | EPDRGYCSESGCYTPYFFDS | SSYTTRSTRV |
| 6 | NGE2925 | QWEGIRS | NSRDSSGNHVV |
| 7 | NGE3064 | DLVAAAGTGLPIGSV | SSYTSASTVI |
| 8 | NGF0104 | KPYLGGRYSAFTPSWFDP | AAWDDSLNGVVF |
| 9 | NGF0128 | ETQHTS1FGVIHNWLDP | AAWDDSLNNLV |
| 10 | NGF0132 | DRRHWGSLDV | AIWDDSLNAWV |
| 11 | NGF0184 | VVGLRLRDAAFDA | AAWDDSLNGYV |
| 12 | NGF0334 | EEYDVWSGPMDV | QSYDSSLRAAV |
| 13 | NGF0540 | HARFGRHDYLGERDVFDI | ASWDDSLNGVV |
| 14 | NGF0719 | DSDTGWFSIDY | ARDSDTGW |
| 15 | NGF0936 | LNSGYDYKWGYYYYGMDV | STRDDRLNGRV |
| 16 | NGF0947 | QEAGRYEALDI | QAYDSSLSGYV |
| 17 | NGE2001 | DLNYDFWSGSGMDV | QQYNSYPLT |
| 18 | NGE2014 | DLNYDFWSSSGMDV | SSYTSSSTLV |
| 19 | NGE2061 | DPPDDQGFDI | QQYSNYPLT |
| 20 | NGE2072 | TSTIVGAKSFDY | SSYTTRSTRV |

TABLE 4-continued

Summary of scFv Groups and CDR 3 Sequences for NogoR Binding Phage Clones Derived by Solid and Solution Phase Selections

| Group | Representative clone | HC CDR 3 Seq. | LC CDR 3 Seq. |
|---|---|---|---|
| 21 | NGE2108 | DLNYDFWSGTGMDV | SSYTTRSTRV |
| 22 | NGE2131 | QRYNSAWFPYYFDL | QRYSNYPLT |
| 23 | NGE2132 | MGAHFGYDHYMDV | SSYTTRSTRV |
| 24 | NGE2164 | ASPATLEWLFPYYYYMDA | QQSYSTPWT |
| 25 | NGE2258 | DPQGYTATRDSWFDP | SSYTTRSTRV |
| 26 | NGE2281 | DFEYKVFDI | SSYTTRSTRV |
| 27 | NGE2433 | DLNYDFWSGLGMDV | SSYTTRSTRV |
| 28 | NGE2435 | QWEGIPS | NSWDSSGNHVV |
| 29 | NGE2439 | GRSRYDFWSGYYGGDYDY YYIDV | NSRDSSGNHVV |
| 30 | NGE2445 | LNYDFWSGLGMDV | SSYTTRSTRV |
| 31 | NGE2446 | GGTLLGY | NSRDSSGNHVV |
| 32 | NGE2447 | ASPATLEWLFPYYYYMDV | QQSYSTPWT |
| 33 | NGE2458 | APVLMAPGGGMDV | NSRDSSGNHVV |
| 34 | NGE2506 | DQSVYFGDLAWYFDL | AAWDDSLSE |
| 35 | NGE2527 | DLNYDFWSGSSMDV | SSYTTRSTRV |
| 36 | NGE2595 | AKSRWYPNYFDY | QQYSNYPLT |
| 37 | NGE2634 | GAYYDFWSGYTPPYYMDV | QQYSNYPLT |
| 38 | N0E2638 | ASGYDGV | ASWDDSLNGRV |
| 39 | NGE2648 | DFWSGYSY | QQYSNYPLT |
| 40 | NGE2741 | EGPPWTNYYFD | QQSYSAPWT |
| 41 | NGE2775 | DLNYDFWSGSGIDV | QSYDSSNHWV |
| 42 | NGE2868 | DVEGYDFWSTYYGMDA | SSYTTRSTRV |
| 43 | NGE2889 | GGARYYYMDV | QQSHSTPWT |
| 44 | NGE2927 | GPHPPRYCSGGSCSYGMDV | QSYDSSLRGSRV |
| 45 | NGE2938 | APAISSSSWPDPASIDY | SSYTTRSTRV |
| 46 | NGE2967 | GGSYQDY | NSRDSSGNHVV |
| 47 | NGE2968 | TGEYSGYDTSGFQH | ASWDDSLNGRV |
| 48 | NGE2988 | GVYYDFWGNHGMDV | SSYTTRSTRV |
| 49 | NGE3006 | MSEYDYYHYYMDV | NSRDSSGNRV |
| 50 | NGE3027 | EASGWYGFAAEYYFDY | DSRDSSGNHVV |
| 51 | NGE3040 | GSDEYAFEM | QQSYSTPWT |
| 52 | NGE3102 | DLNYDFWSGTGMVV | SSYTTRSTRV |
| 53 | NGE3181 | GSLLLDY | NSRDSSGNHVV |
| 54 | NGF0105 | DLVRITLVGVITKSYGMDV | QQYYSLPIT |
| 55 | NGF0114 | VIPPTIGGVTHDSEGMDV | AAWDDGHNGWV |
| 56 | NGF0115 | LASADTGMVTDYKYYDMDV | KSWDSSLRAEV |
| 57 | NGF0121 | PLSGDYYDTSGYHW | SAWDDSLDGVV |

TABLE 4-continued

Summary of scFv Groups and CDR 3 Sequences for NogoR Binding Phage Clones Derived by Solid and Solution Phase Selections

| Group | Representative clone | HC CDR 3 Seq. | LC CDR 3 Seq. |
|---|---|---|---|
| 58 | NGF0134 | HAHYDGSYYYFDY | RSYDSSMSGSRV |
| 59 | NGF0145 | VGDYKEIDAFDI | GAWDDSLISGV |
| 60 | NGF0157 | APKRFGESPNL | AFYLGEGISV |
| 61 | NGF0175 | SKGTKWERREFDY | ASWDDNLNEYV |
| 62 | NGF0186 | DSDYYASSGMGYAFDM | QSYDSSLSGSNV |
| 63 | NGF0190 | DAGTIFDY | QAWDFSSDHPV |
| 64 | NGF0230 | LASAYTGMVTYYKYYDVDV | QSYDTSLSSYV |
| 65 | NGF0238 | EVSGTRNYYYYGLDV | QSYDNRLSVSVV |
| 66 | NGF0244 | GLRDSSGYYFGGYYFDL | LIWHNSAVV |
| 67 | NGF0256 | HASSYYGSFVQYHYYGLQV | MQGTHWPYT |
| 68 | NGF0259 | EVRGSFGEFDY | QVWDSTTDHYV |
| 69 | NGF0271 | PQEPPSSLIAH | GVWDSSLSSYV |
| 70 | NGF0274 | GRGSYYFDSSGPPGYLDL | QSYDRSLRAHV |
| 71 | NGF0282 | DSAYYYDSSGIGNW | QSYDTTLSGSVV |
| 72 | NGF0320 | DPDGDPYWYFDL | QSYDSSLSGYV |
| 73 | NGF0347 | DPGSGPYLSYFDS | AAWDDALNGYV |
| 74 | NGF0387 | DGHYSVGFGFDV | QSYDSSNQGV |
| 75 | NGF0502 | DPPPNIAALSSGYYYMDV | QQYYSTPT |
| 76 | NGF0503 | TSFVVAPDGTGYLDY | QQYKGYSGT |
| 77 | NGF0532 | DHSQPMLYSPDY | VLYMGFGTWV |
| 78 | NGF0577 | EDHDYDLWSDYKGLDV | FSYPRSGGGMLG |
| 79 | NGF0746 | ARSRFGSGSYKNIDLELFYLDN | EHYGSPPRIT |
| 80 | NGF0770 | GDPEELRSDSYFYYGMDV | |
| 81 | NGF0788 | DGPGGQWGAFDI | MLYLGPGIWV |
| 82 | NGF0808 | PLQGIPAAGLDY | GTWDNSLSAGV |
| 83 | NGF0825 | DNRDYYPSGSFGSGLSGYF YYYMDV | QQYGSSPT |
| 84 | NGF0954 | EVADYYGMDV | |
| 85 | NGG2002 | APHYDLWSKYYFRGMDV | SARDDSLNGYV |
| 86 | NGG2004 | EGGILGAVDVFDI | QSYDNSLKNVV |
| 87 | NGG2007 | EGSLDGYFDY | SSRDISDKLLV |
| 88 | NGG2017 | EGHFDYVWGSFSL | QVWDSSTGVV |
| 89 | NGG2022 | DPVGGSYDFWSGSLPIFDY | ATWDGSLKGWV |
| 90 | NGG2043 | LASADTGMVTDYKYYDMDV | QSFDNSLDGWV |
| 91 | NGG2051 | HDILFPYVDV | QSYDSSTVL |
| 92 | NGG2053 | EMAYGDFDH | QMWDSSSDHWV |
| 93 | NGG2071 | LASADTGMVTDYKYYDMDV | ALYMGSGIVV |
| 94 | NGG2086 | EISSVPNWFDP | NSRDTTGKHPV |

TABLE 4-continued

Summary of scFv Groups and CDR 3 Sequences for NogoR Binding Phage Clones Derived by Solid and Solution Phase Selections

| Group | Representative clone | HC CDR 3 Seq. | LC CDR 3 Seq. |
|---|---|---|---|
| 95 | NGG2103 | HYYGLGSFDF | AAFHDGLNDWV |
| 96 | NGG2105 | EGHFDYVSGSFSL | QVWDSSTGVV |
| 97 | NGG2123 | DQSWGTFDY | QVWTTTSDHQWV |
| 98 | NGG2251 | EEYYGSDIFLGNAFDI | QSYDNRLSGVI |

Example 2

Identification and Cloning of VH and VL Domains

One method to identify and clone VH and VL domains from cell lines expressing a particular antibody is to perform PCR with VH and VL specific primers on cDNA made from the antibody expressing cell lines. Briefly, RNA is isolated from the cell lines and used as a template for RT-PCR designed to amplify the VH and VL domains of the antibodies expressed by the EBV cell lines. Cells may lysed in the TRIzol™ reagent (LIFE TECHNOLOGIES™, Rockville, Md.) and extracted with one fifth volume of chloroform. After addition of chloroform, the solution is allowed to incubate at room temperature for 10 minutes, and the centrifuged at 14,000 rpm for 15 minutes at 4° C. in a tabletop centrifuge. The supernatant is collected and RNA is precipitated using an equal volume of isopropanol. Precipitated RNA is pelleted by centrifuging at 14,000 rpm for 15 minutes at 4° C. in a tabletop centrifuge. Following centrifugation, the supernatant is discarded and washed with 75% ethanol. Following washing, the RNA is centrifuged again at 800 rpm for 5 minutes at 4° C. The supernatant is discarded and the pellet allowed to air dry. RNA is the dissolved in DEPC water and heated to 60° C. for 10 minutes. Quantities of RNA can determined using optical density measurements.

cDNA may be synthesized, according to methods well-known in the art, from 1.5-2.5 micrograms of RNA using reverse transcriptase and random hexamer primers. cDNA is then used as a template for PCR amplification of VH and VL domains. Primers used to amplify VH and VL genes are shown in Table 5. Typically a PCR reaction makes use of a single 5' primer and a single 3' primer. Sometimes, when the amount of available RNA template is limiting, or for greater efficiency, groups of 5' and/or 3' primers may be used. For example, sometimes all five VH-5' primers and all JH3' primers are used in a single PCR reaction. The PCR reaction is carried out in a 50 microliter volume containing 1×PCR buffer, 2 mM of each dNTP, 0.7 units of High Fidelity Taq polymerase, 5' primer mix, 3' primer mix and 7.5 microliters of cDNA. The 5' and 3' primer mix of both VH and VL can be made by pooling together 22 pmole and 28 pmole, respectively, of each of the individual primers. PCR conditions are: 96° C. for 5 minutes; followed by 25 cycles of 94° C. for 1 minute, 50° C. for 1 minute, and 72° C. for 1 minute; followed by an extension cycle of 72° C. for 10 minutes. After the reaction is completed, sample tubes were stored 4° C.

TABLE 5

Primer Sequences Used to Amplify VH and VL domains.

| Primer name | SEQ ID NO | Primer Sequence (5'-3') |
|---|---|---|
| VH Primers | | |
| Hu VH1-5' | 8 | CAGGTGCAGCTGGTGCAGTCTGG |
| Hu VH2-5' | 9 | CAGGTCAACTTAAGGGAGTCTGG |
| Hu VH3-5' | 10 | GAGGTGCAGCTGGTGGAGTCTGG |
| Hu VH4-5' | 11 | CAGGTGCAGCTGCAGGAGTCGGG |
| Hu VH5-5' | 12 | GAGGTGCAGCTGTTGCAGTCTGC |
| Hu VH6-5' | 13 | CAGGTACAGCTGCAGCAGTCAGG |
| Hu JH1,2-5' | 14 | TGAGGAGACGGTGACCAGGGTGCC |
| Hu JH3-5' | 15 | TGAAGAGACGGTGACCATTGTCCC |
| Hu JH4,5-5' | 16 | TGAGGAGACGGTGACCAGGGTTCC |
| Hu JH6-5' | 17 | TGAGGAGACGGTGACCGTGGTCCC |
| VL Primers | | |
| Hu Vkappa1-5' | 18 | GACATCCAGATGACCCAGTCTCC |
| Hu Vkappa2a-5' | 19 | GATGTTGTGATGACTCAGTCTCC |
| Hu Vkappa2b-5' | 20 | GATATTGTGATGACTCAGTCTCC |
| Hu Vkappa3-5' | 21 | GAAATTGTGTTGACGCAGTCTGC |
| Hu Vkappa4-5' | 22 | GACATCGTGATGACCCAGTCTCC |
| Hu Vkappa5-5' | 23 | GAAACGACACTCACGCAGTCTCC |
| Hu Vkappa6-5' | 24 | GAAATTGTGCTGACTCAGTCTCC |
| Hu Vlambda1-5' | 25 | CAGTCTGTGTTGACGCAGCCGCC |
| Hu Vlambda2-5' | 26 | CAGTCTGCCCTGACTCAGCCTGC |
| Hu Vlambda3-5' | 27 | TCCTATGTGCTGACTCAGCCACC |
| Hu Vlambda3b-5' | 28 | TCTTCTGAGCTGACTCAGGACCC |
| Hu Vlambda4-5' | 29 | CACGTTATACTGACTCAACCGCC |
| Hu Vlambda5-5' | 30 | CAGGCTGTGCTCACTCAGCCGTC |
| Hu Vlambda6-5' | 31 | AATTTTATGCTGACTCAGCCCCA |
| Hu Jkappa1-3' | 32 | ACGTTTGATTTCCACCTTGGTCCC |
| Hu Jkappa2-3' | 33 | ACGTTTGATCTCCAGCTTGGTCCC |

TABLE 5-continued

Primer Sequences Used to
Amplify VH and VL domains.

| Primer name | SEQ ID NO | Primer Sequence (5'-3') |
|---|---|---|
| Hu Jkappa3-3' | 34 | ACGTTTGATATCCACTTTGGTCCC |
| Hu Jkappa4-3' | 35 | ACGTTTGATCTCCACCTTGGTCCC |
| Hu Jkappa5-3' | 36 | ACGTTTAATCTCCAGTCGTGTCCC |
| Hu Jlambda1-3' | 37 | CAGTCTGTGTTGACGCAGCCGCC |
| Hu Jlambda2-3' | 38 | CAGTCTGCCCTGACTCAGCCTGC |
| Hu Jlambda3--3' | 39 | TCCTATGTGCTGACTCAGCGACC |
| Hu Jlambda3b-3' | 40 | TCTTCTGAGCTGACTCAGGACCC |
| Hu Jlambda4-3' | 41 | CACGTTATACTGACTCAACCGCC |
| Hu Jlambda5-3' | 42 | CAGGCTGTGCTCACTCAGCCGTC |
| Hu Jlambda6-3' | 43 | AATTTTATGCTGACTCAGCCCCA |

PCR samples are then electrophoresed on a 1.3% agarose gel. DNA bands of the expected sizes (~506 base pairs for VH domains, and 344 base pairs for VL domains) can be cut out of the gel and purified using methods well known in the art. Purified PCR products can be ligated into a PCR cloning vector (TA vector from INVITROGEN™ Inc., Carlsbad, Calif.). Individual cloned PCR products can be isolated after transfection of *E. coli* and blue/white color selection. Cloned PCR products may then be sequenced using methods commonly known in the art.

Example 3

Competition Screening Assay to Identify scFv Phage that Inhibit Binding of Myelin Associated Glycoprotein (MAG) to NogoR Research over the last several years has identified at least three known myelin inhibitors including NogoA, Myelin-Associated Glycoprotein (MAG) and Oligodendrocyte Myelin Glycoprotein (OMgp) (reviewed in D. H. S. Lee et. al. Targeting the Nogo receptor to treat central nervous system injuries. Nat Rev Drug Discov. 2003, 2(11):872-8).

An ECL (electrochemiluminisence) based competition screening assay was developed in order to identify NogoR specific scFv's that could inhibit the binding of MAG and thereby prevent the activation of the signaling cascade through p75 and/or LINGO-1. The competition screening assay utilized biotinylated rHuNOGOSR-Flag (recombinant soluble human Flag-tagged NogoR) (Bio-rHuNOGOSR in FIG. 1), prepared using Sulfo-NHS-LC-Biotin (PIERCE™; Rockford, Ill.) as described in Example 1. Recombinant Rat MAG-Fc (R&D Systems) was labeled with the electrochemiluminescent reporter Ori-TAG Ori-TAG=electrochemiluminescent reporter Origen-TAG-NHS (available from BIOVERIS™ Corp., Gaithersburg, Md.)) at a molar challenge ratio of 5:1 according to the manufacturer's instructions. A matrix assay format was employed to determine the lowest concentration of Biotin-rHuNOGOSR-Flag and Ori-TAG-Rat MAG-Fc that gave an ECL signal in the range of 10 to 20 fold over the assay background. For this assay, the Biotin-rHuNOGOSR-Flag was diluted to 1 microgram/ml in Origen Assay Diluent (OAD: PBS; 1% BSA; 0.1% Tween 20) and 100 microliters added to each well of the first row across the top of the plate followed by serial 1:2 dilution down the plate (50 microliters of Biotin-rHuNOG-OSR-Flag into 50 microliters of OAD). In a separate plate the Ori-TAG-Rat MAG-Fc was diluted to 1 microgram/ml in OAD and 200 microliters added to each well down the first column of the plate followed by serial 1:2 dilution across the plate (100 microliters Ori-TAG-MAG into 100 microliters OAD). 50 microliters of the diluted Ori-TAG Rat MAG-Fe was then transferred to the corresponding wells of the plate containing the diluted Biotin-rHuNOGOSR-Flag with a multichannel pipet. Finally, 50 microliters of 1:20 diluted Streptavidin coated magnetic beads (DYNAL™ DYNA-BEADS™ M280 magnetic beads, 10 mg/ml; DYNAL™ Biotech, Brown Deer, Wis.) in OAD was added per assay well followed by vigorous shaking for 40 minutes after which the ECL signal was determined in each well of the plate using an Origen Mg series ECL analyzer (BIOVERIS™ Corp., Gaithersburg, Md.). Assay results showed that Biotin-rHuNOG-OSR-Flag at a final concentration of 0.03 micrograms/ml, Ori-TAG Rat MAG-Fc at a final concentration of 0.125 micrograms/ml and M280 beads at a final concentration of 167 micrograms/ml gave the optimal signal for the competition format.

Phage expressing scFv were prepared from the entire panel of unique rHuNOGOSR-Flag specific scFv phage clones (see Table 1) using the protocol described in Example 1. For the competition screening assay, 5 microliters of scFv phage supernatant from each clone was transferred to 96 well plates and incubated with 75 microliters of 0.063 micrograms/ml Biotin-rHuNOGOSR-Flag at room temperature with gentle shaking. After 60 to 90 minutes, 75 microliters of 0.25 micrograms/ml Ori-TAG Rat MAG-FC with 357 micrograms/ml of DYNAL™ Streptavidin M280 beads was added followed by vigorous shaking at room temperature. After 40 minutes, the ECL signal was determined for each well using the Origen M8 analyzer. Clones that showed a reduction in assay signal of greater than 93% were scored as positive for the ability to compete MAG binding to soluble NogoR.

In order to verify the MAG blocking activity of the scFv phage clones identified from the assay results described above, the competition screening assay was repeated with soluble scFv protein as follows. The scFv protein was purified from periplasmic lysates of selected positive clones using Ni-NTA chromatography following standard protocols. The protein concentration of each scFv preparation was determined by a combination of absorbance at $OD_2$go nM and polyacrylamide gel electrophoresis analysis under denaturing conditions using scFv standards of known concentration. The scFv protein for each clone was titrated into the standard Ori-TAG Rat MAG-FC and Biotin-rHuNOGOSR-Flag ECL competition screening assay at final concentration ranging from 0.05 micrograms/ml (0.32 nM) to 6.25 micrograms/ml (42 nM). Results of the competition screening assay with soluble scFv protein from eight different NogoR specific scFv clones showed that the scFv protein from seven clones effectively competed the binding of Ofi-TAG Rat MAG-FC to Biotin-rHuNOGOSR-Flag as compared to a non-inhibitor negative control scFv, 3D11.

Anti-NOGOR scFv's corresponding to SEQ ID NOs:50-66 blocked binding of the Rat MAG-Fc to NogoR by one or both of the assays described above. The VH and VL domains from scFv of SEQ ID NOs:50-66 were recloned into Human Gamma1F Heavy and Human Kappa or Lambda Light expression vectors, respectively. These heavy and light chain expression constructs can be used to produce fully human IgG.

Example 4

Competition Screening Assay to Identify Antibodies that Inhibit Binding of NOGO66 Ligand to rHuNOGOSR Research over the last several years has identified at least three known myelin inhibitors including NogoA, Myelin-Associated Glycoprotein (MAG) and Oligodendrocyte Myelin Glycoprotein (OMgp) (reviewed in D. H. S. Lee et. al. Targeting the Nogo receptor to treat central nervous system injuries. Nat Rev Drug Discov. 2003, 2(11):872-8). Nogo-66 is a 66 amino acid peptide fragment from the C-terminus of NogoA that can function on its own as a potent inhibitor of neurite outgrowth (Fournier et al, Identifcation of a receptor mediating Nogo-66 inhibtion of axonal regeneration. Nature, 2001, 409:341-346).

An ECL (electrochemii Luminisence) based competition screening assay was developed in order to identify NogoR specific antibodies that could inhibit the binding of Nogo66 and thereby prevent the activation of the signaling cascade through p75 and/or LINGO-1, which in the appropriate cell type leads to neurite outgrowth inhibition and growth cone collapse. The competition screening assay utilized biotinylated rHuNOGOSR-Flag (recombinant soluble human Flag-tagged NogoR), prepared using Sulfo-NHS-LC-Biotin (PIERCE™ Rockford, Ill.) at a molar challenge ratio of 5:1 following the manufacturers protocol (see, PIERCE™ Instructions for EZ-Link Sulfo-NHS-Biotin Reagents 21217 21335 21338). Recombinant NOGO66 ligand was produced as a fusion protein with recombinant Human Placental Alkaline Phosphatase (rHuPLAP) using a commercially available expression vector (pAPtag-5, GENHUNTER™ Corp., Nashville, Tenn.). The specific interaction of rHuPLAP-NOGO66 with rHuNOGOSR was measured in an ECL based assay format by creating a complex of Biotin-rHuNOGOSR, huPLAP-NOGO66 and an Ori-TAG labeled Rabbit-anti-HuPLAP polyclonal IgG (Ori-TAG=electrochemiluminescent reporter Origen-TAG-NHS (available from BIOVERIS™ Corp., Gaithersburg, Md.) which is captured on a Streptavidin coated magnetic bead and analyzed with an Origen M8 series ECL analyzer (BIOVERIS™ Corp., Gaithersburg, Md.). The assay was adapted to screen for antibodies able to inhibit the binding of rHuPLAP-NOGO66 to rHuNOGOSR as follows. Twenty-five µl of culture supernatants from individual hybridomas expressing antibodies thought to be specific to rHuNOGOSR were added to each individual well of a 96 well plate. Biotin-rHuiNOGOSR was diluted to a final concentration of 0.85 µg/ml in Origen Assay Diluent (OAD: PBS; 1% BSA; and, 0.1% Tween 20) followed by the addition of Streptavidin coated magnetic beads or SAM's (DYNAL™ DYNABEADS™ M280 magnetic beads, 10 mg/ml; DYNAL™ Biotech, Brown Deer, Wis.) to a final concentration of 417 µg/ml or a 1:24 dilution of the bead stock. The SAM's and biotinylated antigen were allowed to mix for 45 minutes and then 60 µls was added to each well containing the hybridoma culture supernatant. The antibody and antigen bead mixture was allowed to mix for 60 minutes followed by the addition of 60 µls of 0.85 µg/ml rHuPLAP-NOGO66 and 1 µg/ml of Ori-TAG labeled Rabbit-anti-HuPLAP polyclonal IgG diluted in OAD. After an additional 45 minute incubation the ECL signal was determined for each well using the Origen M8 series ECL analyzer. The ECL signal in each well was then compared to control wells containing just culture medium with no antibody or culture supernatant from a clone expressing an irrelevant, IgG. Sample results obtained with antibodies converted from scFv's into full IgG4 antibody molecules (via methods described herein), are shown in FIG. 1.

Example 5

Electrochemiluminescent Assay for Detection of IgG Antibodies to NogoR

The following assay may be used to test if IgG antibodies of the invention are able to bind NogoR. Briefly, 288 microliters of streptavidin coated beads (M-28-DYNABEADS™ available from DYNAL BIOTECH™, Cat No. 110.26) are added to 20 milliliters of 0.1% BSA/PBST in a 50 mL conical tube. Biotinylated sNogoR and ORI-TAG labelled goat anti-Human IgG specific antibody (Vector Labs) are added to this solution such that the final concentration of sNogoR and ori-tagged goat anti-human IgG is 0.15 micrograms/ml and 0.25 micrograms/ml. This solution is incubated for 30 minutes at room temperature with gentle inversion. 200 microliters of this mixture is then aliquoted individual wells of 96 well polypropylene plates. 20 microliters of test antibody and/or control antibody diluted, e.g. in HT media or in 0.1% BSA/PBST, are added to each well. The plates are incubated 1 hour at room temperature with shaking. The plates are then read on the Origen M8 series ECL analyzer.

Example 6

Europium Based Assay to Determine the Relative Binding of an Antibody to NOGOR Expressed on the Surface of a Cell The following assay may be used to determine the ability of IgG antibodies of the invention to recognize and bind specifically to, recombinant, human, NOGO, full-length receptor (rHuNOGOFLR) expressed on the surface of a cell. Once bound the antibody can be specifically detected using Mouse-anti-Human IgG labeled with a Europium (Eu) Tag (Mu-anti-HuIgG-Eu, Perkin Elmer, Boston, Mass.) and which when resuspended in an appropriate enhancement solution generates a fluorescent signal that can be measured and quantitated using an instrument designed for that purpose such as the Wallac Viktor2 or Envision plate reader (Perkin Elmer, Boston, Mass.).

The general protocol for this type of assay is as follows. An appropriate cell line such as NSO or CHO-K1 is first stably transfected with a plasmid vector that expresses rHuNOGOFLR resulting in medium to high levels of NOGOR on the cell surface. The stable cells are grown for several days in fresh culture medium using standard cell culture techniques, gently pelleted by centrifugation and resuspended in PBS containing 0.1% BSA to a density of $4 \times 10^6$ cells/ml. The Mu-anti-HuIgG-Eu (Perkin Elmer, Boston, Mass.) is added to the cell suspension to a final concentration of 2 µg/ml and then plated into round bottom polypropylene 96 well plate at 25 µls/well. Twenty-five uals of the test sample such as hybridoma culture supernatant or purified IgG diluted in PBS+0.1% BSA is added to each well and the plate is covered and incubated for 60 minutes at room temperature with gentle shaking. Centrifuge the plate in a tabletop centrifuge for 5 minutes at room temperature at 1,500 rpm. Using a multichannel pipet carefully remove all the supernatant without disturbing the cell pellets changing tips between rows of samples to avoid Eu carry over. Wash the cell pellets twice with PBS by gently resuspending pellets in 200 µls of PBS, pelleting cells and removing the supernatant as described above. Resuspend cell pellets in 100 μls/well of PE Enhancement Solution (ES, Perkin Elmer, Boston, Mass.) and read plate within one hour of adding ES on the Wallac Viktor2 or Envision readers (Perkin Elmer, Boston, Mass.). The level of fluorescent signal or counts are used to evaluate the relative binding of the IgG, with counts of 100,000 or less regarded as no binding and counts at or above 100,00 regarded as positive binding. The level of counts can be used as an approximation of the binding affinity, provided the concentration of the IgG in the supernatant or sample is known.

Example 7

Relative Affinity Determination Using ELISA Assay

The following assay may be used to determine the affinity of IgG antibodies of the invention for NogoR relative to one another. Under ideal circumstances antibody concentration at half-maximal antigen binding (EC50) is a measure of affinity. In practical terms, EC50 values can be used to rank the affinities of antibodies to quickly identify best binders. The lower the antibody concentration required for 50% of plateau binding the higher the affinity of that antibody for antigen. In the approach described below a conventional ELISA is used to determine binding curves for NOGOr antibodies in order to derive their EC-50 values.

Preparation of ELISA Plates: 100 microliters of sNOGOr solution (0.02 micrograms/ml in PBS) is dispensed into individual wells of 96-well plates (Immulon-4, Dynex) sealed with plate sealers and incubated overnight at 4° C. The next day the coating solution is removed, plates are washed 4 times with PBS+0.1% Tween-20 and blocked by incubation with 200 microliters of blocking buffer (PBS, 3% BSA) for 1 hour at room temperature.

Sample preparation: Eight 1:5 serial dilutions of antibody sample are prepared in diluent buffer (PBS, 0.1% Tween-20, 0.1% BSA). Human IgG2 (SIGMA, cat# 14139) is used as a negative control.

ELISA: Two 100 microliter aliquots of each antibody sample dilution are dispensed into individual wells of coated and blocked plates. The plates are sealed and incubated for 2 hours at room temperature. Next, plates are washed 4 times with PBST (PBS, 0.1% Tween-20) and 100 microliters of horseradish peroxidase (HRP) labeled anti-human IgG specific antibody (Southern Biotech) at a concentration 0.25 micrograms/ml in diluent buffer is dispensed to individual wells. Plates are sealed and incubated for 1 hour at room temperature. Plates are washed 4 times with PBST and 100 microliters of substrate (2 component TMB, Kirkegaard & Perry Laboratories, Inc., Cat No. 50-76400) is added to each well. Plates are incubated for 10 minutes at room temperature until the colorimetric reaction is stopped with 100 microliters/well of 1M $H_2SO_4$. The plates are read at an absorption of 450 nm on a SpectraMax Plus reader (Molecular Devices).

Data can be analyzed using SofMaxPro 4.3.1. Binding curves in coordinates OD 450 vs concentration are generated using the four parameter fit model. EC-50 values are calculated automatically as the concentration of the antibody that provides 50% of the maximum binding (maximum binding is characterized by parameter D in the four parameter fit equation).

Example 8

In Vitro Dorsal Root Ganglion (DRG) Neurite Outgrowth Assays

Preparation of rat spinal cord myelin. Fourteen adult rat spinal cords were ground into a fine powder in a ceramic mortar and pestle on dry ice. The ground tissue was transferred in aliquots to a 15 ml dounce glass tissue homogenizer with a teflon pestle to which 10 mls of ice cold 15 mM HEPES, pH 7.2 and a cocktail of protease inhibitors was added. The suspension was homogenized for 15 minutes on ice, then centrifuged at 5,000×g for 30 minutes at 2 degrees C. The supernate was collected and the pellet resuspended in 10 mls ice cold HEPES buffer, and centrifuged as above. The two supernates were combined and layered onto 0.32M and 0.85M 2-step sucrose gradients and centrifuged at 75,000×g for 2 hours at 2 degrees C. The interface was collected and diluted 5 fold with HEPES buffer plus protease inhibitors, then centrifuged again at 75,000×g for 2 hours at 2 degrees C. The final pellet was resuspended in 1% CHAPS in HEPES plus protease inhibitors and incubated at room temperature for 2 hours with gentle rocking. The extract was centrifuged again at 75,000×g for 2 hours at 2 degrees C., the supernate was collected, and transferred to dialysis tubing (3000 MWCO). Samples were dialyzed against 4 liters of 5 mM HEPES, pH 7.2 plus protease inhibitors for 2 days with 2 changed of buffer to remove the detergent. The final product was measured for protein content by microBCA protein assay, and the samples frozen as aliquots and stored at −80 C until ready or use.

Embryonic day 14 (E14) DRG were collected by dissection from rat embryos, and the roots trimmed by fine forceps. The ganglia were collected, and incubated in 0.05% trypsin-EDTA at 37 degrees for 15 minutes. Fetal bovine serum was added to 10% final concentration and the ganglia centrifuged at 200×g for 3 minutes. The media was removed and replaced with 3 mls of neural basal medium. The ganglia were dissociated by tritration with a fire polished glass pipette, until a single cell suspension was formed. Cells were added to 24 well plates at a density of 20,000 cells per well. Each well contained a 12 mm coverslip pre-coated with myelin as follows. Coverslips were coated overnight with poly-L-lysine, washed 3× with sterile distilled water, then allowed to air dry. 40 ul of a suspension of 1 um fluorescent polystyrene beads in medium containing purified myelin was added to the center of each well and allowed to air dry. Each spot contained 960 ng of solubilized myelin. The coverslips were washed 2× with medium before addition of cells. Antibodies (anti-NogoR and control antibodies) were tested in either duplicate or triplicate wells and were added at the time of plating at a final concentration of 40 ug/ml in a total volume of 0.5 mls. The control antibody used was either a CCR5 specific IgG4 or an isotype matched control antibody, with an unknown specificity.

Cultures were incubated for 12 hours at 37 degrees, 5% $CO_2$, after which time the coverslips were fixed with 4% paraformaldehyde for 15 minutes, washed 3× with PBS/0.1% Tween-20, then blocked overnight with 5% fetal bovine serum, 5% rat serum in PBS/01% Tween-20. The cultures were stained with rabbit anti-beta-tubulin III (clone Tuj1) 1:400 overnight at 4 degrees in blocking solution, washed 3× with PBS/0.1% Tween-20, then incubated for 2 hours with goat anti-rabbit secondary antibodies labeled with Alexa-555. The coverslips were washed 3×, then mounted in MOWLIOL mounting medium and observed under a fluorescent microscope (Zeiss Axioscope) under a 20× objective. Representative fields of view were captured using the Olympus Microsuite software package and a Roper Coolsnap fx cooled CCD camera.

Quantification of neurite outgrowth. Digital images of DRG cultures were captured as described above. Each field of view was centered on an individual or cluster of cell bodies such that the maximum amount of neurite outgrowth could be captured. Images were collected in a serpentine pattern until images of all neurons on a given coverslip were collected. Typically 40-55 fields of view were captured per well. Tuj1+ fibers were then traced using a 12" digitizing tablet and the Olympus Microsuite software package. The length of each neurite was recorded in a spreadsheet, and the total length of all fibers for a given condition was divided by the number of neurons observed to give the average neurite length. Only those neurites that were completely contained within the filed of view were measured. Measurements are representative of approximately 300 neurons per coverslip.

Results. Results indicate that anti-NogoR antibodies can promote the growth of neurites in the presence of myelin (which contains high concentrations of NOGOR specific ligands that inhibit neurite outgrowth).

Example 9

Spinal Cord Injury and Treatment with Neutralizing Nogo Receptor Antibodies

Adult female Sprague Dawley rats (6-8 weeks of age, 200-250 gm; Zivic Inc., Zelienople, Pa.) were used for all experiments in 3 separate experimental paradigms. A right over-hemisection injury was generated at the T6 spinal level using procedures described previously (see, Bregman B. S., Brain Res. 1987 August; 431 (2):245-63 (August 1987); Bregman B. S., Brain Res., 431(2):265-79 (August 1987); and, Bregman B. S., et al., Exp Neurol., 123(1):3-16 (September 1993)). Briefly, after laminectomy, the dura was opened, and the spinal cord was partially transected using iridectomy scissors. In this lesion model the entire right half of the cord and the cortical spinal tract and dorsal columns on the left side were cut. A small piece of saline-soaked gel foam was placed on top of the lesion cavity. Either 2 week or 4 week osmotic mini-pumps were placed under the skin below the level of the lesion. Small plastic tubing connected to the pump was guided to the lesion are and sutured in place. A small hole in the tubing was made immediately above the lesion area facing towards the lesion. Another piece of saline soaked gel foam was placed on top of the tubing and the muscles and skin were closed with nylon sutures and metal staples, respectively. Pumps contained 240 ug to 1 mg of antibody per pump, depending on the experiment. Antibodies were diluted in PBS, sterile filtered, and loaded within a tissue culture hood. Pumps were selected at random for placing into animals.

Example 10

Cortical Spinal Tract Tracing and Anti-Serotonin (5HT) Antibody Immunoreactivity Four weeks post injury animals were anesthetized with 4% chloral hydrate (1 ml/100 g body weight) and the sensorimotor cortices exposed by removing an area of the skull with a Dremel microtool. An area of the skull from 3 mm anterior to bregma 5 mm posterior to the bregma, and from 1 to 5 mm lateral to the midline bilaterally. A Hamilton syringe was used to inject 5 ul of a 10% solution biotinylated dextran amine (BDA) (10,000 molecular weight, in 0.9% saline) into the cortex bilaterally. Ten to 14 days post injection the brain and spinal cord were collected following perfusion transcardially, and 20 um section prepared. For quantification of axon growth, the spinal cord containing lesion, and up to 10 mm caudal to lesion was cut longitudinally in a 1:6 series. Sections on every sixth slide were analyzed, generating 18-22 sections per animal for analysis. The sections were stored at −20 degrees C. until ready for use. To visualize corticospinal tracts, sections were stained using the aviden-peroxidase system and diaminobenzidine (DAB). For detection of serotonergic fibers, sections were incubated with rabbit anti-5HT antibodies, followed by peroxidase-anti-peroxidase.

Embodiments of the Invention Include (But are not Limited to)

A. An isolated antibody or fragment thereof comprising a first amino acid sequence at least 95% identical to a second amino acid sequence selected from the group consisting of:
   (a) the amino acid sequence of either VHCDR1, VHCDR2, or VHCDR3 referred to in Table 1; and
   (b) the amino acid sequence of either VLCDR1, VLCDR2, or VLCDR3 referred to in Table 1;
wherein said antibody or fragment thereof specifically binds NogoR.

B. The antibody or fragment thereof of embodiment A, wherein the second amino acid sequence consists of the amino acid sequence of a VHCDR3 referred to in Table 1.

C. The antibody or fragment thereof of embodiment A, that binds NogoR purified from a cell culture wherein the cells in said cell culture comprise a polynucleotide encoding amino acids 1 to 473 of SEQ ID NO:2 operably associated with a regulatory sequence that controls gene expression.

D. An isolated antibody or fragment thereof comprising:
   (a) an amino acid sequence that is at least 90% identical to a VH domain referred to in Table 1;
   (b) an amino acid sequence that is at least 90% identical to a VL domain referred to in Table 1; or
   (c) both (a) and (b);
wherein said antibody or fragment thereof specifically binds NogoR.

E. The antibody or fragment thereof of embodiment D, wherein said antibody or fragment thereof inhibits the interaction with p75(NTR).

F. The antibody or fragment thereof of embodiment D, wherein said antibody or fragment thereof inhibits the interaction with LINGO-1.

G. The antibody or fragment thereof of embodiment D, wherein said antibody or fragment thereof prevents Nogo binding to NogoR.

H. The antibody or fragment thereof of embodiment D, wherein said antibody or fragment thereof prevents OMgp binding to NogoR.

I. The antibody or fragment thereof of embodiment D, wherein said antibody or fragment thereof prevents MAG binding to NogoR.

J. The antibody or fragment thereof of embodiment D, wherein said antibody or fragment thereof promotes neurite outgrowth.

K. The antibody or fragment thereof of embodiment D, wherein said antibody or fragment thereof promotes axonal regeneration.

L. The antibody or fragment thereof of embodiment D, that binds NogoR expressed on the surface of a cell wherein said NogoR is encoded by a polynucleotide encoding amino acids 1 to 473 of SEQ ID NO:2 operably associated with a regulatory sequence that controls expression of said polynucleotide.

M. The antibody or fragment thereof of embodiment D comprising:
   (a) the amino acid sequence of a VH domain from an antibody referred to in Table 1;

(b) the amino acid sequence of a VL domain from an antibody referred to in Table 1; or
(c) both (a) and (b);
wherein said antibody or fragment thereof specifically binds NogoR.

N. The antibody or fragment thereof of embodiment M comprising the amino acid sequences of a VH domain and a VL domain from the same antibody referred to in Table I.

O. The antibody or fragment thereof of embodiment M, wherein said antibody or fragment thereof inhibits the interaction with p75(NTR).

P. The antibody or fragment thereof of embodiment M, wherein said antibody or fragment thereof inhibits the interaction with LINGO-1.

Q. The antibody or fragment thereof of embodiment M, wherein said antibody or fragment thereof promotes neurite outgrowth.

R. The antibody or fragment thereof of embodiment M, wherein said antibody or fragment thereof promotes axonal regeneration.

S. The antibody or fragment thereof of embodiment M, that binds NogoR purified from a bacterial cell culture wherein the cells in said cell culture comprise a polynucleotide encoding amino acids 1 to 473 of SEQ ID NO:2 operably associated with a regulatory sequence that controls gene expression.

T. The antibody or fragment thereof of embodiment D wherein the antibody or fragment thereof is selected from the group consisting of:
(a) a whole immunoglobulin molecule;
(b) an scFv;
(c) a monoclonal antibody;
(d) a human antibody;
(e) a chimeric antibody;
(f) a humanized antibody;
(g) a Fab fragment;
(h) an Fab' fragment;
(i) an F(ab')2;
(k) an Fv; and
(k) a disulfide linked Fv.

U. The antibody or fragment thereof of embodiment D wherein the antibody or fragment thereof is a human antibody.

V. The antibody or fragment thereof of embodiment D which comprises a heavy chain immunoglobulin constant domain selected from the group consisting of:
(a) a human IgM constant domain;
(b) a human IgG1 constant domain;
(c) a human IgG2 constant domain;
(d) a human IgG3 constant domain;
(e) a human IgG4 constant domain; and
(f) a human IgA constant domain.

W. The antibody or fragment thereof of embodiment D which comprises a light chain immunoglobulin constant domain selected from the group consisting of:
(a) a human Ig kappa constant domain; and
(b) a human Ig lambda constant domain.

X. The antibody or fragment thereof of embodiment D wherein the antibody or fragment thereof has a dissociation constant (KD) selected from the group consisting of:
(a) a dissociation constant (KD) between $10^{-7}$ M (inclusive) and $10^{-8}$ M; and
(b) a dissociation constant (KD) between $10^{-8}$ M (inclusive) and $10^{-9}$ M.

Y. The antibody or fragment thereof of embodiment D wherein the antibody or fragment thereof has a dissociation constant (KD) of less than or equal to $10^{-9}$ M.

Z. The antibody or fragment thereof of embodiment Y wherein the antibody or fragment thereof has a KD between $10^{-9}$ M and $10^{-10}$ M.

AB. The antibody or fragment thereof of embodiment Y wherein the antibody or fragment thereof has a KD between $10^{-10}$ M (inclusive) and $10^{-11}$ M.

AC. The antibody or fragment thereof of embodiment Y wherein the antibody or fragment thereof has a KD between $10^{-11}$ M (inclusive) and $10^{-12}$ M.

AD. The antibody or fragment thereof of embodiment D wherein the antibody or fragment thereof is conjugated to a detectable label.

AE. The antibody or fragment thereof of embodiment AD, wherein the detectable label is a radiolabel.

AF. The antibody or fragment thereof of embodiment AE, wherein the radiolabel is $^{125}$I, $^{131}$I, $^{111}$In, $^{90}$Y, $^{99}$Tc, $^{177}$Lu, $^{166}$Ho, or $^{153}$Sm.

AG. The antibody or fragment thereof of embodiment AD, wherein the detectable label is an enzyme, a fluorescent label, a luminescent label, or a bioluminescent label.

AH. The antibody or fragment thereof of embodiment D wherein the antibody or fragment thereof is biotinylated.

AI. The antibody or fragment thereof of embodiment D wherein the antibody or fragment thereof is conjugated to a therapeutic or cytotoxic agent.

AJ. The antibody or fragment thereof of embodiment AI, wherein the therapeutic or cytotoxic agent is selected from the group consisting of:
(a) an anti-metabolite;
(b) an alkylating agent;
(c) an antibiotic;
(d) a growth factor;
(e) a cytokine;
(f) an anti-angiogenic agent;
(g) an anti-mitotic agent;
(h) an anthracycline;
(i) toxin; and
(j) an apoptotic agent.

AK. The antibody or fragment thereof of any one of embodiment D wherein the antibody or fragment thereof is attached to a solid support.

AL. The antibody or fragment thereof of embodiment D wherein the antibody or fragment thereof specifically binds NogoR in a Western blot.

AM. The antibody or fragment thereof of embodiment D wherein the antibody or fragment thereof specifically binds NogoR in an ELISA.

AN. An isolated cell that produces the antibody or fragment thereof of embodiment A3.

AO. An antibody or fragment thereof that binds the same epitope on a NogoR polypeptide as an antibody or fragment thereof of embodiment M.

AP. The antibody or fragment thereof of embodiment D in a pharmaceutically acceptable carrier.

AQ. A method of treating or ameliorating spinal cord injury comprising administering to an animal the antibody or fragment thereof of embodiment D or a composition containing said antibody or fragment thereof.

AR. The method of embodiment AQ wherein the animal is a human.

AS. The method of embodiment AQ wherein the antibody or fragment thereof is administered in combination with a second agent selected from the group consisting of:
(a) a neuroprotective agent;
(b) a neuroreparative agent;
(c) a neurotrophic agent;
(d) a neurorestorative agent;
(e) a neuroregenerative agent; and
(f) a neuroconstructive agent.

AT. The method of embodiment AS wherein the neuroprotective agent is selected from the group up consisting of:
(a) glucocorticoids;
(b) tetracyclines;
(c) glutamate receptor blockers;
(d) GABA receptor antagonists; and
(e) cycloxygenase blockers.

AU. The method of embodiment AT wherein the glucocorticoid is methylprednisolone.

AV. The method of embodiment AS wherein the neuroreparative agent is selected from the group up consisting of:
(a) protein kinase modulators;
(b) inflammatory cells; and
(c) lymphocyte activators.

AW. The method of embodiment AS wherein the neurotrophic agent is selected from the group up consisting of:
(a) protein growth factors;
(b) purine nucleotides;
(c) cell adhesion molecules; and
(d) hormones.

AX. The method of embodiment AS wherein the neurorestorative agent is selected from the group up consisting of:
(a) potassium channel blockers;
(b) neurotransmitters;
(c) electrical stimulation;
(d) forced-use training.

AY. The method of embodiment AS wherein the neuroregenerative agent is selected from the group up consisting of:
(a) Nogo inhibitors;
(b) NogoR inhibitors;
(c) chondroitinase; and
(d) therapeutic vaccines.

AZ. The method of embodiment AS wherein the neuroconstructive agent is selected from the group up consisting of:
(a) embryonic stem cells;
(b) fetal stem cells;
(c) olfactory ensheathing glial cells;
(d) adult stem cells;
(e) Schwann cells;
(f) neuronal-restricted precursor cells;
(g) glial-restricted precursor cells; and
(h) oligodendroglial precursor cells.

BA. The method of embodiment AZ wherein the neuroconstructive agent is cell line derived.

BB. A kit comprising the antibody or fragment thereof of embodiment D.

BC. The kit of embodiment BB comprising a control antibody.

BD. The kit of embodiment BB, wherein the antibody or fragment thereof is coupled or conjugated to a detectable label.

It will be clear that the invention may be practiced otherwise than as particularly described in the foregoing description and examples. Numerous modifications and variations of the present invention are possible in light of the above teachings and, therefore, are within the scope of the appended claims.

The entire disclosure of all publications (including patents, patent applications, journal articles, laboratory manuals, books, or other documents) cited herein are hereby incorporated by reference.

SEQUENCE LISTING (249 sequences)

SEQ ID NO: 1 - DNA, 1441 bp, Homo sapiens
ccaacccctacgatgaagagggcgtccgctggagggagccggctgctggcatgggtgctgtggctgcaggcctggcaggtggcagccccatgcccaggtgcctgcgtatgctacaatgagcccaaggtgacgacaagctgcccccagcagggcctgcaggctgtgcccgtgggcatccctgctgccagccagcgcatcttcctgcacggcaaccgcatctcgcatgtgccagctgccagcttccgtgcctgccgcaacctcaccatcctgtggctgcactcgaatgtgctggcccgaattgatgcggctgccttcactggcctggccctcctggagcagctggacctcagcgataatgcacagctccggtctgtggaccctgccacattccacggcctgggccgcctacacacgctgcacctggaccgctgcggcctgcaggagctgggcccggggctgttccgcggcctggctgccctgcagtacctctacctgcaggacaacgcgctgcaggcactgcctgatgacaccttccgcgacctgggcaacctcacacacctcttcctgcacggcaaccgcatctccagcgtgcccgagcgcgccttccgtgggctgcacagcctcgaccgtctcctactgcaccagaaccgcgtggcccatgtgcacccgcatgccttccgtgaccttggccgcctcatgacactctatctgtttgccaacaatctatcagcgctgcccactgaggccctggcccccctgcgtgccctgcagtacctgaggctcaacgacaacccctgggtgtgtgactgccgggcacgcccactctgggcctggctgcagaagttccgcggctcctcctccgaggtgccctgcagcctcccgcaacgcctggctggccgtgacctcaaacgcctagctgccaatgacctgcagggctgcgctgtggccaccggcccttaccatcccatctggaccggcagggccaccgatgaggagccgctggggcttcccaagtgctgccagccagatgccgctgacaaggcctcagtactggagcctggaagaccagcttcggcaggcaatgcgctgaagggacgcgtgccgcccggtgacagcccgccgggcaacggctctggcccacggcacatcaatgactcaccctttgggactctgcctggctctgctgagcccccgctcactgcagtgcggcccgagggctccgagccaccagggttccccacctcgggccctcgccggaggccaggctgttcacgcaagaaccgcacccgcagccactgccgtctgggccaggcaggcagcgggggtggcgggactggtgactcagaaggctcaggtgccctacccagcctcacctgcagcctcacccccctgggcctggcgctggtgctgtggacagtgcttgggccctgctgacccccag

SEQ ID NO: 2 - protein, 473 aa, Homo sapiens
MKRASAGGSRLLAWVLWLQAWQVAAPCPGACVCYNEPKVTTSCPQQGLQAVPVGIPAASQRIFLHGNRISHVPAASFRACRNLTILWLHSNVLARIDAAAFTGLALLEQLDLSDNAQLRSVDPATFHGLGRLHTLHLDRCGLQELGPGLFRGLAALQYLYLQDNALQALPDDTFRDLGNLTHLFLHGNRISSVPERAFRGLHSLDRLLLHQNRVAHVHPHAFRDLGRLMTLYLFANNLSALPTEALAPLRALQYLRLNDNPWVCDCRARPLWAWLQKFRGSSSEVPCSLPQRLAGRDLKRLAANDLQGCAVATGPYHPIWTGRATDEEPLGLPKCCQPDAADKASVLEPGRPASAGNALKGRVPPGDSPPGNGSGPRHINDSPFGTLPGSAEPPLTAVRPEGSEPPGFPTSGPRRRPGCSRKNRTRSHCRLGQAGSGGGGTGDSEGSGALPSLTCSLTPLGLALVLWTVLGPC

SEQ ID NO: 3 - protein, 1192 aa, Homo sapiens [sequence omitted]

SEQ ID NO: 4 - protein, 440 aa, Homo sapiens
  misc_feature (21)..(21): Xaa can be any naturally occurring amino acid
MEYQILKMSLCLFILLFLTPXILCICPLQCICTERHRHVDCSGRNLSTLPSGLQENIIHLNLSYNHFTDLHNQLTQYTNLRTLDISNNRLESLPAHLPRSLWNMSAANNNIKLLDKSDTAYQWNLKYLDVSKNMLEKVVLIKNTLRSLEVLNLSSNKLWTVPTNMPSKLHIVDLSNNSLTQILPGTLINLTNLTHLYLHNNKFTFIPDQSFDQLFQLQEITLYNNRWSCDHKQNITYLLKWMMETKAHVIGTPCSTQISSLKEHNMYPTPSGFTSSLFTVSGMQTVDTINSLSVVTQPKVTKIPKQYRTKETTFGATLSKDTTFTSTDKAFVPYPEDTSTETINSHEAAAATLTIHLQDGMVTNTSLTSSTKSSPTPMTLSITSGMPNNFSEMPQQSTTLNLWREETTTNVKTPLPSVANAWKVNASFLLLLNVVVMLAV

SEQ ID NO: 5 - protein, 626 aa, Homo sapiens
MIFLTALPLFWIMISASRGGHWGAWMPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVSCMVPDNCPELRPELSWLGHEGLGEPAVLGRLREDEGTWVQVSLLHFVPTREANGHRLGCQASFPNTTLQFEGYASMDVKYPPVIVEMNSSVEAIEGSHVSLLCGADSNPPPLLTWMRDGTVLREAVAESLLLELEEVTPAEDGVYACLAENAYGQDNRTVGLSVMYAPWKPTVNGTMVAVEGETVSILCSTQSNPDPILTIFKEKQILSTVIYESELQLELPAVSPEDDGEYWCVAENQYGQRATAFNLSVEFAPVLLLESHCAAARDTVQCLCVVKSNPEPSVAFELPSRNVTVNESEREFVYSERSGLVLTSILTLRGQAQAPPRVICTARNLYGAKSLELPFQGAHRLMWAKIGPVGAVVAFAILIAIVCYITQTRRKKNVTESPSFSAGDNPPVLFSSDFRISGAPEKYESERRLGSERRLLGLRGEPPELDLSYSHSDLGKRPTKDSYTLTEELAEYAEIRVK

SEQ ID NO: 6 - protein, 427 aa, Homo sapiens
MGAGATGRAMDGPRLLLLLLLGVSLGGAKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEANHVDPCLPCTVCEDTERQLRECTRWADAECEEIPGRWITRSTPPEGSDSTAPSTQEPEAPPEQDLIASTVAGVVTTVMGSSQPVVTRGTTDNLIPVYCSILAAVVVGLVAYIAFKRWNSCKQNKQGANSRPVNQTPPPEGEKLHSDSGISVDSQSLHDQQPHTQTASGQALKGDGGLYSSLPPAKREEVEKLLNGSAGDTWRHLAGELGYQPEHIDSFTHEACPVRALLASWATQDSATLDALLAALRRIQRADLVESLCSESTATSPV

SEQ ID NO: 7 - protein, 614 aa, Homo sapiens
MLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISHRAFSGLNSLEQLTLEKCNLTSIPTEALSHLHGLIVLRLRHLNINAIRDYSFKRLYRLKVLEISHWPYLDTMTPNCLYGLNLTSLSITHCNLTAVPYLAVRHLVYLRFLNLSYNPISTIEGSMLHELLRLQEIQLVGGQLAVVEPYAFRGLNYLRVLNVSGNQLTTLEESVFHSVGNLETLILDSNPLACDCRLLWVFRRRWRLNFNRQQPTCATPEFVQGKEFKDFPDVLLPNYFTCRRARIRDRKAQQVFVDEGHTVQFVCRADGDPPPAILWLSPRKHLVSAKSNGRLTVFPDGTLEVRYAQVQDNGTYLCIAANAGGNDSMPAHLHVRSYSPDWPHQPNKTFAFISNQPGEGEANSTRATVPFPFDIKTLIIATTMGFISFLGVVLFCLVLLFLWSRGKGNTKHNIEIEYVPRKSDAGISSADAPRKFNMKMI

SEQ ID NO: 8 - DNA, 23 bp, Artificial sequence
  PCR primer useful for amplifying VH and VL domains
caggtgcagctggtgcagtctgg

SEQ ID NO: 9 - DNA, 23 bp, Artificial sequence
  PCR primer useful for amplifying VH and VL domains
caggtcaacttaagggagtctgg

SEQ ID NO: 10 - DNA, 23 bp, Artificial sequence
  PCR primer useful for amplifying VH and VL domains
gaggtgcagctggtggagtctgg

SEQ ID NO: 11 - DNA, 23 bp, Artificial sequence
  PCR primer useful for amplifying VH and VL domains
caggtgcagctgcaggagtcggg

SEQ ID NO: 12 - DNA, 23 bp, Artificial sequence
  PCR primer useful for amplifying VH and VL domains
gaggtgcagctgttgcagtctgc

SEQ ID NO: 13 - DNA, 23 bp, Artificial sequence
  PCR primer useful for amplifying VH and VL domains
caggtacagctgcagcagtcagg

SEQ ID NO: 14 - DNA, 24 bp, Artificial sequence
  PCR primer useful for amplifying VH and VL domains
tgaggagacggtgaccagggtgcc

SEQ ID NO: 15 - DNA, 24 bp, Artificial sequence
  PCR primer useful for amplifying VH and VL domains
tgaagagacggtgaccattgtccc

SEQ ID NO: 16 - DNA, 24 bp, Artificial sequence
  PCR primer useful for amplifying VH and VL domains
tgaggagacggtgaccagggttcc

SEQ ID NO: 17 - DNA, 24 bp, Artificial sequence
  PCR primer useful for amplifying VH and VL domains
tgaggagacggtgaccgtggtccc

SEQ ID NO: 18 - DNA, 23 bp, Artificial sequence
  PCR primer useful for amplifying VH and VL domains
gacatccagatgacccagtctcc

SEQ ID NO: 19 - DNA, 23 bp, Artificial sequence
  PCR primer useful for amplifying VH and VL domains
gatgttgtgatgactcagtctcc

SEQ ID NO: 20 - DNA, 23 bp, Artificial sequence
  PCR primer useful for amplifying VH and VL domains
gatattgtgatgactcagtctcc

SEQ ID NO: 21 - DNA, 23 bp, Artificial sequence
  PCR primer useful for amplifying VH and VL domains
gaaattgtgttgacgcagtctcc

SEQ ID NO: 22 - DNA, 23 bp, Artificial sequence
  PCR primer useful for amplifying VH and VL domains
gacatcgtgatgacccagtctcc

SEQ ID NO: 23 - DNA, 23 bp, Artificial sequence
  PCR primer useful for amplifying VH and VL domains
gaaacgacactcacgcagtctcc

SEQ ID NO: 24 - DNA, 23 bp, Artificial sequence
  PCR primer useful for amplifying VH and VL domains
gaaattgtgctgactcagtctcc

SEQ ID NO: 25 - DNA, 23 bp, Artificial sequence
  PCR primer useful for amplifying VH and VL domains
cagtctgtgttgacgcagccgcc

SEQ ID NO: 26 - DNA, 23 bp, Artificial sequence
  PCR primer useful for amplifying VH and VL domains
cagtctgccctgactcagcctgc

SEQ ID NO: 27 - DNA, 23 bp, Artificial sequence
  PCR primer useful for amplifying VH and VL domains
tcctatgtgctgactcagccacc

SEQ ID NO: 28 - DNA, 23 bp, Artificial sequence
  PCR primer useful for amplifying VH and VL domains
tcttctgagctgactcaggaccc

SEQ ID NO: 29 - DNA, 23 bp, Artificial sequence
  PCR primer useful for amplifying VH and VL domains
cacgttatactgactcaaccgcc

SEQ ID NO: 30 - DNA, 23 bp, Artificial sequence
  PCR primer useful for amplifying VH and VL domains
caggctgtgctcactcagccgtc

SEQ ID NO: 31 - DNA, 23 bp, Artificial sequence
  PCR primer useful for amplifying VH and VL domains
aattttatgctgactcagcccca

SEQ ID NO: 32 - DNA, 24 bp, Artificial sequence
  PCR primer useful for amplifying VH and VL domains
acgtttgatttccaccttggtccc

SEQ ID NO: 33 - DNA, 24 bp, Artificial sequence
  PCR primer useful for amplifying VH and VL domains
acgtttgatctccagcttggtccc

SEQ ID NO: 34 - DNA, 24 bp, Artificial sequence
  PCR primer useful for amplifying VH and VL domains
acgtttgatatccactttggtccc

SEQ ID NO: 35 - DNA, 24 bp, Artificial sequence
  PCR primer useful for amplifying VH and VL domains
acgtttgatctccaccttggtccc

SEQ ID NO: 36 - DNA, 24 bp, Artificial sequence
  PCR primer useful for amplifying VH and VL domains
acgtttaatctccagtcgtgtccc

SEQ ID NO: 37 - DNA, 23 bp, Artificial sequence
  PCR primer useful for amplifying VH and VL domains
cagtctgtgttgacgcagccgcc

SEQ ID NO: 38 - DNA, 23 bp, Artificial sequence
  PCR primer useful for amplifying VH and VL domains
cagtctgccctgactcagcctgc

SEQ ID NO: 39 - DNA, 23 bp, Artificial sequence
  PCR primer useful for amplifying VH and VL domains
tcctatgtgctgactcagccacc

SEQ ID NO: 40 - DNA, 23 bp, Artificial sequence
  PCR primer useful for amplifying VH and VL domains
tcttctgagctgactcaggaccc

SEQ ID NO: 41 - DNA, 23 bp, Artificial sequence
  PCR primer useful for amplifying VH and VL domains
cacgttatactgactcaaccgcc

SEQ ID NO: 42 - DNA, 23 bp, Artificial sequence
  PCR primer useful for amplifying VH and VL domains
caggctgtgctcactcagccgtc

SEQ ID NO: 43 - DNA, 23 bp, Artificial sequence
  PCR primer useful for amplifying VH and VL domains
aattttatgctgactcagcccca

SEQ ID NO: 44 - protein, 330 aa, Homo sapiens [sequence omitted]

SEQ ID NO: 45 - protein, 327 aa, Homo sapiens
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 46 - protein, 106 aa, Homo sapiens
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 47 - protein, 105 aa, Homo sapiens
QPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 48 - protein, 19 aa, Homo sapiens
MGWSCIILFLVATATGAHS

SEQ ID NO: 49 - protein, 19 aa, Homo sapiens
MGWSCIILFLVATATGVHS

SEQ ID NO: 50 - protein, 241 aa, Artificial Sequence
  scFv protein NGE2005
EGSWWSLGEAWSSLGGSLRLSCAASGFTFSDYYMSWIRQAPGKGLEWVSYISSSGGTIYYADSVKGRFTFSRDNAKNSLYLQMNSLRAEDTAVYYCARGLERHYVDVWGKGTMVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 51 - protein, 248 aa, Artificial Sequence
  scFv protein NGE2077
EVQLVQSGAEVKKPGSSVKVSCKASGDTFSSFGFSWVRQAPGQGLEWMGGIIPMYGTAKYAQKFQDRVTITADESMSTVYMELNSLRSDDTAVYYCARGPLVRYYFYYMDVWGRGTMVTVSSGGGGSGGGGSGGGGSQSVLTQPPSASGTPGQRVTISCSGSSSNIGSNTVNWYQRLPGAAPQLLIYNNDQRPSGIPDRFSGSRSGTSGSLVISGLQSEDEADYYCASWDDSLNGRVFGGGTKLTVLG

SEQ ID NO: 52 - protein, 247 aa, Artificial Sequence
  scFv protein NGE2105
QVQLVQSGGGVVQPGESLRLSCAASGFTLSSYAMAWVRQAPGKGLEWIGNIYFGGSAYYNPSLKSRVTISLATSENQFSLKLTSVTAADTAMYFCAREINDYGDFGGYDLWGQGTMVTVSSGGGGSGGGGSGGGGSQSVLTQPASVSGSPGQSITISCTGTSSDVGGYNYVSWYQQHPGKTPKLMIYEGSKRPSGISNRFSGSKSGNTASLTISGLQAEDEADYYCSSYTTRSTRVFGGGTKLTVLG

SEQ ID NO: 53 - protein, 250 aa, Artificial Sequence
  scFv protein NGE2122
EVQLVQSGAEVKKPGSSVKVSCKASGGTLRSFAISWVRQAPGQGLEWVGRIIPVLNIADYAQKFRGRVTLTADDFTDTAYMELSRLTSDDSAIYYCAKDRETVTTNWAYYFDYWGQGTMVTVSSGGGGSGGGGSGGGGSQSALTQPASVSGSRGQSITISCTGTTGDVGGYDYVSWYQQHPGKAPKLLIYGNSNRPSGVPDRFSASKSGNTASLTISGLQAEDEADYFCSTYAPPGIIMFGGGTKLTVLG

SEQ ID NO: 54 - protein, 255 aa, Artificial Sequence
  scFv protein NGE2902
  Site (31): Xaa equals any of the naturally occurring L-amino acids
  Site (35): Xaa equals any of the naturally occurring L-amino acids
QVQLVESGGGVVQPGKSLRLSCEASGFTLQXLWHXRVRQAPGKGLTRVSYIDSTEGVIYYADTFQGRFTISRDNSKSTVYLHMSSLLPDDAGVYYCAREPDRGYCSESGCYTPYFFDSWGRGTMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTIAGLQAEDEADYYCSSYTTRSTRVFGGGTKLTVLG

SEQ ID NO: 55 - protein, 239 aa, Artificial Sequence
  scFv protein NGE2925
QVQLQESGPGLVKPSETLSLTCVVSGGSISSSNWWSWVRQPPGKGLEWIGEIYHSGSPNYNPSLKSRVTISVDKSKNQFSLKLSSVTSADTAVYYCARQWEGIRSWGQGTLVTVSRGGGGSGGGGSGGGGSSELTQDPAVSVALGQTVRITCQGDSLRSYYASWYQQKPGQAPVLVIYGKNNRPSGIPDRFSGSSSGNTASLTITGARAEDEADYYCNSRDSSGNHVVFGGGTKLTVLG

SEQ ID NO: 56 - protein, 250 aa, Artificial Sequence
  scFv protein NGE3064
EVQLVQSGGGVVQPGRSLRLSCAASGFTFSDYGIHWVRQAPGKGLEWVAAILYDGSNQFYTDSVKGRFTLSRDISKNTLYLQMNSLRVEDTAVYYCVRDLVAAAGTGLPIGSVWGRGTMVTVSSGGGGSGGGGSGGGGSQSVLTQPASVSGSPGQSITISCTGTSSDVGGYNYVSWYQQHPGKAPKFMIYDVSKRPSGVSNRFSGSKSGNTASLTISGVQAEDEADYYCSSYTSASTVIFGGGTKLTVLG

SEQ ID NO: 57 - protein, 256 aa, Artificial Sequence
  scFv protein NGF0540
QVQLQESGPGVVKPSETLSLSCTVSGDSISTSDYYWGWVRQPPGKGLEWIGSLFYRGTTYYSPSLKSRVSISVDTSKNQFSLNLSSVTASDTAVYFCARHARFGRHDYLGERDVFDIWGRGTMVTVSSGGGGSGGGGSGGGGSALSYELTQPPSASGTPGQRVTISCSGSSPNIGSNTVNWYQQLPGTAPKLLIHTNNQRPSGVPDRFSGSKSGTSASLAISGLQSEDEADYYCASWDDSLNGVVFGGGTKLTVLG

SEQ ID NO: 58 - protein, 247 aa, Artificial Sequence
  scFv protein NGF0719
EVQLVQSGTEVKKPGASVKVSCKASGYTFSSYYMHWVRQAPGQGLEWMGVINPGGDVTGYAPKFQDRVTMTRDTSTSTLYMELSSLRSEDTALYYCARDSDTGWFSIDYWGRGTLVTVSSGGGGSGGGGSGGGGSAQAVLTQPSSVSGTPGQTVIISCSGSNSNIRGNTVNWYQQLPGSAPRLLIYSNNIRPSGVPDRFSGSKSDTSASLAISGLQSEDEADFYCATWDDSLRGLVIGGGTKLTVLG

SEQ ID NO: 59 - protein, 254 aa, Artificial Sequence
  scFv protein NGF0936
QVQLQESGAEVKKPGSSVKVSCKASGGTFSSYAISWVRQAPGQGLEWMGGIIPIFGTANYAQKFQGRVTITADESTSTAYMELSSLRSEDTAVYYCATLNSGYDYKWGYYYYGMDVWGRGTLVTVSSGGGGSGGGGSGGGGSAQPVLTQPPSASGAPGQTVTISCSGSSSNVGSNTVDWYQQLPGSAPKLLIYTNDQRPSGVPDRFSGSKSGTSASLAISGLQSEDEADYYCSTRDDRLNGRVFGGGTKLPVLG

SEQ ID NO: 60 - protein, 248 aa, Artificial Sequence
  scFv protein NGF0947
QVQLQESGGGLVQPGGSLRLSCAASGLNLRQEEMNWVRQTPEKGLEWISYISSGGGSRDYADSVKGRFTISRDNAKNLMYLQMNNLRAEDTAVYYCARQEAGRYEALDIWGRGTLVTVSSGGGGSGGGGSGGGGSAQSVLTQPPSVSGAPGQTVTISCTGTTSNIGAGYDVHWYQQVPGTAPKVLIYGSRNRPSGVPYRFSGFKSGTSASLAITGLQAEDEADYYCQAYDSSLSGYVFGMGTQLTVLS

SEQ ID NO: 61 - protein, 255 aa, Artificial Sequence
  scFv protein NGF1A04
EVQLVETGAEVKKPGSSVKVSCKASGGTFSNYAVSWVRQAPGQGLEWMGGIIPIFGIPNYAQKFQGRLTITADESTSTAYMELSSLRSEDTAIYYCARKPYLGGRYSAFTPSWFDPWGQGTLVTVSSGGGGSGGGGSGGGGSALSYELTQPPSASGTPGQRVTISCSGSSSNIGSNTVNWYQQLPGTAPKLLIYSNNQRPSGVPDRFSGSKSGTSASLAISGLQSEDEADYYCAAWDDSLNGVVFGGGTKLTVLG

SEQ ID NO: 62 - protein, 254 aa, Artificial Sequence
  scFv protein NGF1C04
QVQLQQSGPGLVRPSQTLSLACTVSGDSISSGDYYWTWIRQHPGKGLEWIGYISTRGSPYYNPSFMNRVAISIDSSKNQFSLNLSSVTAADTAVYYCTRETQHTSIFGVIHNWLDPWGQGTLVTVSSGGGGSGGGGSGGGGSAQAVLTQPSSASGTPGQRVSISCSGSSSNIGSNTVNWYQQLPGTAPKLLIYSGNQRPSGVPDRFSGSKSGTSASLAISGLQSEDEADYYCAAWDDSLNNLVFGPGTKVTVLG

SEQ ID NO: 63 - protein, 245 aa, Artificial Sequence
  scFv protein NGF1E07
EVQLVESGAEVKKPGASVKVSCKVSGDTLAELTMHWVRQAPGNGLEWMGGYDPESGETKHAQKFQGRVTMTEDTSTDTAYMELSSLRSEDTAVYYCAADRRHWGSLDVWGKGTLVTVSSGGGGSGGGGSGGGGSALSYVLTQPPSVSEAPGQRVTISCSGGNVGSSSVNWYQQLPGKAPTLLIYYDTVLTSGVSARFSGSRSATSASLAISGLQSEDEADYYCAIWDDSLNAWVFGGGTQLTVLS

SEQ ID NO: 64 - protein, 250 aa, Artificial Sequence
  scFv protein NGF1G12
EVQLVQSGAEVKKPGSSVKVSCKASGDTFSSYAITWVRQAPGQGLEWMGGIIPIYGTANYAQKFQGRVTITADESTNTAYMKLSSLRSEDTAVYYCARVVGLRLRDAAFDAWGQGTMVTVSSGGGGSGGGGSGGGGSALSYVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGTGTKLTVLG

SEQ ID NO: 65 - protein, 249 aa, Artificial Sequence
  scFv protein NGF3C10
QLQLQESGPGLVKPSGTLSLTCAVTGDSITSNNWWSWVRQAPGKGLEWIGDVYHTGTTNYNPSLKSRVTISVDESKNQFSLKVTSVTTADTAVYYCAREEYDVWSGPMDVWGQGTLVTVSSGGGGSGGGGSGGGGSAQAVLTQPSSVSGAPGQRVSISCTGSSSNIGAGYDVHWYQQLPGTAPKLLIYGNINRPSGVPDRFSGSKSGTSASLAITGLQAEDEADYYCQSYDSSLRAAVFGGGTKVTVLG

SEQ ID NO: 66 - protein, 256 aa, Artificial Sequence
  scFv protein NGG2208
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARDRTYDFWSGYDNPADFYAAMDVWGRGTLVTVSSGGGGSGGGGSGGGGSALDIQLTQSPSSVSASVGDRVTMTCRASQVIDSWLAWYQQKPGKAPKLLVYAASSLQSGVPSRFSGSGSGTDFTLTISSVQPEDFATYYCQQAYSFPITFGQGTRLEIKR

SEQ ID NO: 67 - protein, 246 aa, Artificial Sequence
  scFv protein NGE2001
EVQLVQSGGVVVQPGGSLRLSCAASGFTFDDYAMHWVRQAPGKGLEWVSLISWDGGSTYYADSVKGRFTISRDNSKNSLYLQMNSLRAEDTALYYCAKDLNYDFWSGSGMDVWGQGTLVTVSSGGGGSGGGGSGGGGSDVVMTQSPSSLSASLGDRVTITCRASQDITNDLAWYQQKPGKAPKLLIYGASTLQYGVPTRFSGSGSGTNFSLTISSLQPEDFATYYCQQYNSYPLTFGGGTKVEIKR

SEQ ID NO: 68 - protein, 249 aa, Artificial Sequence
  scFv protein NGE2014
QVQLVQSGGVVVQPGGSLRLSCAASGFTFDDYAMHWVRQAPGKGLEWVSLISWDGGSTYYADSVKGRFTISRDNSKNSLYLQMNSLRAEDTALYYCAKDLNYDFWSSSGMDVWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTSSSTLVFGGGTKLTVLG

SEQ ID NO: 69 - protein, 244 aa, Artificial Sequence
  scFv protein NGE2061
QVQLQQSGPGLVKPSQTLSLTCAISGDSVSSNSAAWNWIRQSPSRGLEWLGRTYYRSQWHNDFAPFVQSRIAVNPDTSKNQFSLHLKFVTSEDTAVYYCARDPPDDQGFDIWGRTMVTVSSGGGGSGGGGSGGGGSDVVMTQSPSSLSASVGDRVAITCRASQGISNYLAWYQQKPGKAPKLLIYKASTLESGVPSRFSGSGSGTEFTLTISSLQPDDFATYYCQQYSNYPLTFGGGTKLEIKR

SEQ ID NO: 70 - protein, 246 aa, Artificial Sequence
  scFv protein NGE2072
QMQLVQSGGGVVQPGRSLRLSCAASGFTFSSYGMHWVRQAPGKGLEWVATIWYDGTKYYSDSVKGRFTISRDNSKNTLYLEMNSLRGEDTAVYYCVRTSTIVGAKSFDYWGRGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 71 - protein, 249 aa, Artificial Sequence
  scFv protein NGE2108
QVQLVESGGGLVQPGGSLRLSCATSGFTFDDYAMHWVRQAPGKGLEWVSLISWDGGSTYYADSVKGRFTISRDNSKNSLYLQMNSLRAEDTALYYCAKDLNYDFWSGTGMDVWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 72 - protein, 247 aa, Artificial Sequence
  scFv protein NGE2131
QVTLKESGPGLVKPSETLSLTCTVSGGSISSSSYYWGWIRQPPGKGLEWIGSIYYSGNTYDNPSLKSRLTMSVDTSRNQFSLKLSSVTAADTAVYYCARQRYNSAWFPYYFDLWGRGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQRYSNYPLTFGGGTKLEIKR

SEQ ID NO: 73 - protein, 247 aa, Artificial Sequence
  scFv protein NGE2132
  Site (4): Xaa equals any of the naturally occurring L-amino acids
  Site (13): Xaa equals any of the naturally occurring L-amino acids
QCSXRVGGSRVQXGRSLKLSCAASGLPFRNYGMHWVRPAPGKGWEWAAFISYEGSNKYYVDSVKGDFTVSRDNPKNTLYLQMNSLRGDDTAAYYCAKMGAHFGYDHYMDVWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 74 - protein, 250 aa, Artificial Sequence
  scFv protein NGE2164
EVQLVQSGGGLLQPGRSLRLSCAASGFTFSSYSMNWVRQAPGKGPEWVSAISGSGGSTYYADSVKGRFTISRDNSKNTLYLQMNSLRAEDTAVYYCAKASPATLEWLFPYYYYMDAWGRGTLVTVSSGGGGSGGGGSGGGGSDIVMTQSPSTLSASVGDRVTITCRASQGISSWLAWYQQRPGRAPKVLIYKASTLESGVPSRFSGSGSGTDFTLTISSLQPEDFATYYCQQSYSTPWTFGQGTKLEIKR

SEQ ID NO: 75 - protein, 250 aa, Artificial Sequence
  scFv protein NGE2258
QMQLVQSGGGLVKSGGSLRLSCAASGFTFSDYYMSWVRQAPGKGLEWISYISSSGSIIYYADSVRGRFTISRDNADNSLYLHMNSLRADDTAVYYCARDPQGYTATRDSWFDPWGQGTMVTVSSGGGGSGGGGSGGGGSQSVLTQPASVSGSPGRSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 76 - protein, 243 aa, Artificial Sequence
  scFv protein NGE2281
RGAAGGDWGRCGQPGRSLRLSCAASGFTVSSTYMSWVRQAPGKGLEWVSVLYSGGTTAYADSVIDRSTISRDNAKNSLYLQMNSLRDEDTAVYYCARDFEYKVFDIWGRGTLVTVSSGGGGSGGGGSGGGGSQSVLTQPASVSGSPGQSITISCTGTSSDVGGYNYVSWYQQHPGKAPKLMIYEGSKRPSGASNRFSGSKSGNTASLTISGLQAEDEADYYCSSYTTRSTRVFGGGTKLTVLG

SEQ ID NO: 77 - protein, 249 aa, Artificial Sequence
  scFv protein NGE2433
QVQLVQSGGVVVQPGGSLRLSCAASGFTFDDYAMHWVRQAPGKGLEWVSLISWDGGSTYYADSVKGRFTISRDNSKNSLYLQMNSLRAEDTALYYCAKDLNYDFWSGLGMDVWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 78 - protein, 239 aa, Artificial Sequence
  scFv protein NGE2435
QVQLQESGPGLVKPSETLSLTCVVSGGSISSSNWWSWVRQPPRKGLEWIGEIYHSGSPNYNPSLKSRVTISVDKSKNQFSLKLSSVTPADTAVYYCARQWEGIPSWGKGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSWDSSGNHVVFGGGTKLTVLG

SEQ ID NO: 79 - protein, 255 aa, Artificial Sequence
  scFv protein NGE2439
EVQLVESGAEVKEPGASVKVSCKASGYTFTGYYMHWVRQAPGQGLEWMGWINPNSGDTHYAQKFQGRVTMTRDTSVSTAYMELSSLRSEDTAVYYCARGRSRYDFWSGYYGGDYDYYYIDVWGQGTTVTVSSGGGGSGGGGSGGGGSSELTQDPAVSVALGQTVRITCQGDSLRSYYASWYQQKPGQAPVLVIYGKDNRPSGIPDRFSGSSSGNTASLTITGAQAEDEADYYCNSRDSSGNHVVFGGGTKLTVLG

SEQ ID NO: 80 - protein, 249 aa, Artificial Sequence
  scFv protein NGE2445
EVQLVQSGGVVVQPGGSLRLSCAASGFTFDDYAMHWVRQAPGKGLEWVSLISWDGGSTYYADSVKGRFTISRDNSKNSLYLQMNSLRAEDTALYYCAKDLNYDFWSGLGMDVWGQGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISELQAEDEADYYCSSYTTRSTRVFGGGTKLTVLG

SEQ ID NO: 81 - protein, 238 aa, Artificial Sequence
  scFv protein NGE2446
QVQLQQSGPGLVRPSETLSLTCAVYGESLTGYYWSWIRQAPGQGLEWIGEINHSETTNYNPSLKSRLTISVDTSKNQFSLKLTSVTAADTAVYYCARGGTLLGYWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 82 - protein, 250 aa, Artificial Sequence
  scFv protein NGE2447
EVQLVQSGGGLVQPGGSLRLSCAASGFTFSSYSMNWVRQAPGKGPEWVSAISGSGGSTYYADSVKGRFTISRDNSKNTLYLQMNSLRAEDTAVYYCAKASPATLEWLFPYYYYMDVWGQGTTVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 83 - protein, 245 aa, Artificial Sequence
  scFv protein NGE2458
QVQLQQSGAEVKKPGSSVTVSCKASGGTFTSYAINWVRQAPGQGLEWMGRTIPDLGIADYAQKFQGRVSITAHKFTNTAYMELSSLKSDDTAVYYCARAPVLMAPGGGMDVWGKGTLVTVSSGGGGSGGGGSGGGGSSELTQDPAVSVALGQTVRITCQGDSLKSYYASWYQQKPGQAPVLVIYGKNNRPSGIPDRFSGSSSGNTASLTITGAQAEDEADYYCNSRDSSGNHVVFGGGTKLTVLG

SEQ ID NO: 84 - protein, 250 aa, Artificial Sequence
  scFv protein NGE2506
EVQLVESGGGVVQPGRSLRLSCAASGFTFRSYGMHWVRQAPGKGLEWVAGISYDGSNKYYADSVKGRFTISRDNSKNTLYLQMNSLRAEDTAMYYCARDQSVYFGDLAWYFDLWGRGTLVTVSSGGGGSGGGGSGGGGSQSVLTQPPSVSAAPGQKVTISCSGSTSNIGNNYVSWYQQHPGKAPKLMIYDVSKRPSGVPDRFSGSKSGNSASLDISGLQSEDEADYYCAAWDDSLSEFLFGTGTKLTVLG

SEQ ID NO: 85 - protein, 249 aa, Artificial Sequence
  scFv protein NGE2527
QVQLVQSGGVLVQPGGSLRLSCAASGFTFDDYAMHWVRQAPGKGLEWVSLISWDGGSTYYADSVKGRFTISRDNSKNSLYLQMNSLRAEDTALYYCATDLNYDFWSGSSMDVWGKGTMVTVSSGGGGSGGGGSGGGGSQSVLTQPASVSGSPGQSITISCTGASSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 86 - protein, 244 aa, Artificial Sequence
  scFv protein NGE2595
QVRLVQSGAEVKKPGASVKVSCKASGYTFTGYYMHWVRQAPGQGLEWMGWINPNSGGTNYAQKFQGRATMTRDTSISTAYMELSRLRSDDTAVYYCARAKSRWYPNYFDYWGQGTMVTVSSGGGGSGGGGSGGGGSDIQMTQSPSTLSASIGVRVTITCRASEGIYHWLAWYQQKPGKAPKLLIYEASSLASGAPSRFSGSESGTDFTLTISSLQPDDFATYYCQQYSNYPLTFGGGTKLEIKR

SEQ ID NO: 87 - protein, 250 aa, Artificial Sequence
  scFv protein NGE2634
QVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCAKGAYYDFWSGYTPPYYMDVWGRGTMVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 88 - protein, 242 aa, Artificial Sequence
  scFv protein NGE2638
QVQLVQSGGGLVKPGGSLRLSCAASGFTFSSYEMNWVRQAPGKGLEWVSYISSSGSTIYYADSVKGRFTISRDNAKNSLYLQMNSLRAEDTAVYYCARASGYDGVWGQGTLVTVSSGGGGSGGGGSGGGGSQSVLTQPPSASGTPGQRVTISCSGSSSNVGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 89 - protein, 242 aa, Artificial Sequence
  scFv protein NGE2648
QVQLQQSGRGLVQPGRSLRLSCTASGFTFGDYAMSWVRQAPGKGLEWVGLIRSKAYGGTTEYAASVKGRFTISRDDSKSIAYLQMNSLRTEDTAVYYCATDFWSGYSYWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKR

SEQ ID NO: 90 - protein, 244 aa, Artificial Sequence
  scFv protein NGE2741
GVQLVQSGAEVKKPGASVKVSCKTSGYSFTDYFIHWVRQAPGQGLEWMGWINPQSGGSHSAQKFHGRVTVTRDTSIKTAYMEVTSLTSDDTAVYFCAREGPPWTNYYFDYWGRGTLVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSAPWTFGQGTKLEIKR

SEQ ID NO: 91 - protein, 249 aa, Artificial Sequence
  scFv protein NGE2775
QVQLVQSGGVVVQPGGSLRLSCAASGFTFDDYAMHWVRQAPGKGLEWVSLISWDGGSTYYADSVKGRFTISRDNSKNSLYLQMNSLRAEDTALYYCAKDLNYDFWSGSGIDVWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNSASLTISGLKTEDEADYYCQSYDSSNHWVFGGGTKLTVLG

SEQ ID NO: 92 - protein, 251 aa, Artificial Sequence
  scFv protein NGE2868
EVQLVQSGGVVVQPGGSLRLSCAASGFIFDDYAMHWVRRAPGKGLEWVSLISWDGGSTYYADSVKGRFTISRDNSKNSLYLQMNSLRAEDTALYYCAKDVEGYDFWSTYYGMDAWGQGTTVTVSSGGGGSGGGGSGGGGSQSVLTQPASVSGSPGQSITISCTGTSSDVGGYNYVSWYQQRPGKAPKLMIYEGSKRPSGVSNRFSGSKSGNTASLTISGLQAEDEADYYCSSYTTRSTRVFGGGAKLTVLG

SEQ ID NO: 93 - protein, 242 aa, Artificial Sequence
  scFv protein NGE2889
EVQLVESGAEVKKPGASVKVSCKASGYTFTSYYMHWVRQAPGQGLEWMGWMNPNSGNTGYAQKFQGRVTMTRNTSISTAYMELSSLRSEDTAVYYCARGGARYYYMDVWGKGTLVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSHSTPWTFGQGTKLEIKR

SEQ ID NO: 94 - protein, 255 aa, Artificial Sequence
  scFv protein NGE2927
QVQLVQSGGGVVQPGRSLRLSCAASGFTFSSYGMHWVRQAPGKGLEWVAVISYDGSNKYYADSVKGRFTISRDNSKNTLYLQMNSLRAEDTAVYYCARGPHPPRYCSGGSCSYGMDVWGRGTMVTVSSGGGGSGGGGSGGGGSSYVLTQPPSVSGTPGQRVTISCSGGRSNIGSNTVKWYQQLPGTAPKLLIYGNDQRPSGVPDRFSGSKSGTSASLAITGVQAEDEADYYCQSYDSSLRGSRVFGTGTKVTVLG

SEQ ID NO: 95 - protein, 253 aa, Artificial Sequence
  scFv protein NGE2938
QVQLQQWGPGLVKPSQTLSLTCTVSGGSISSRDHFWSWVRQTPGKGLEWIGYMYYNGITNYNPSLKSRVTISVDTSKNQVSLQLNSVTAADTAVYYCARAPAISSSSWPDPASIDYWGQGTLVTVSSGGGGSGGGGSGGGGSQTVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 96 - protein, 238 aa, Artificial Sequence
  scFv protein NGE2967
QVQLQQWGAGLLKPSETLSLTCAVYGGSFSGYYWSWIRQPPGKGLEWIGEVDHSGDTTYRPSLRSRVTISVDTSKNQFSLKLSSVTAADTAVYYCARGGSYQDYWGQGTVVTVSSGGGGSGGGGSGGGGSSELTQDPAVSVASGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 97 - protein, 249 aa, Artificial Sequence
  scFv protein NGE2968
QVQLVQSGGGVVQPGRSLRLSCAASGFTFSSYGMHWVRQAPGKGLEWVAVISYDGSIKYYADSVKGRFTISRDNSKNTLYLQMNSLRAEDTAVYYCARTGEYSGYDTSGFQHWGRGTLVTVSSGGGGSGGGGSGGGGSQSVLTQPPSASGTPGQRVTISCSGSSSNIGSNTVNWYQRLPGAAPQLLIYNNDQRPSGIPDRFSGSKSGTSGSLVISGLQSEDEADYYCASWDDSLNGRVFGGGTKLTVLG

SEQ ID NO: 98 - protein, 250 aa, Artificial Sequence
  scFv protein NGE2988
QVQLQQSGPGLVKPSETLSLTCTVSGGSVSSGSYFWSWIRQPPGKGLEWIGNIYYSGSTNYNPSLKSRVTISVDTSRNQFSLKLSSVTAADTAVYYCARGVYYDFWGNHGMDVWGKGSMVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 99 - protein, 244 aa, Artificial Sequence
  scFv protein NGE3006
EVQLVQSGGEVKRPGASVKVSCKASGSTFASYGISWVRQAPGQGLEWMGWISDSNTNTKYAQRFHGRVSLTTDTSTNTAFMELRSLTSDDTAIYYCAVMSEYDYYHYYMDVWGRGTTVTVPSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNRVFGGGTKLTVLG

SEQ ID NO: 100 - protein, 250 aa, Artificial Sequence
  scFv protein NGE3027
EVQLVETGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTEASGWYGFAAEYYFDYWGQGTLVTVSSGGGGSGGGGSGGGGSSELTQDPAVSVALGQTVRITCQGDSLRSYYASWYQQKPGQAPVLVIYGKNNRPSGIPDRFSGPSSGNTASLTITGAQAEDEADYYCDSRDSSGNHVVFGGGTKLTVLG

SEQ ID NO: 101 - protein, 241 aa, Artificial Sequence
  scFv protein NGE3040
EVQLVQSGAEVKKTGSSVKVFCKASGYTFTYRYLHWVRQAPGQALEWMGWITPFNGNTNYAQKFQDRVTITRDRSMTTASMELSSLRSEDTAMYYCVTGSDEYAFEMWGQGTLVTVSSGGGGSGGGGSGGGGSDIVMTQSPSTLSASVGDRVTITCRASQGISSWLAWYQQKPGRAPKVLIYKASTLESGVPSRFSGSGSGTDFTLTISSLQPEDFATYYCQQSYSTPWTFGQGTKLEIKR

SEQ ID NO: 102 - protein, 249 aa, Artificial Sequence
  scFv protein NGE3102
QVQLVESGGGLVQPGGSLRLSCATSGFTFDDYAMHWVRQAPGKGLEWVSLISWDGGSTYYADSVKSRFTISRDSSNNFLYLQMNSLRAEDTALYCCAKDLNYDFWSGTGMVVWGKGTLVTVSSGGGGSGGGGSGGGGSQSVLTQPASVSGSPGQSITISCTGTSSDVGGYNYVSWYQQHPGKAPKLMIYEGSKRPSGVSNRFSGSKSGNTASLTISGLQAEDEADYYCSSYTTRSTRVFGGGTKLTVLG

SEQ ID NO: 103 - protein, 238 aa, Artificial Sequence
  scFv protein NGE3181
QVQLQQWGAGLLKPSETLSLTCAVYGGSFSGYYWSWIRQPPGKGLEWIGEINHSGSTNYNPSLKSRVTISADTSKNQFSLKLSSVTAADTAVYYCARGSLLLDYWGRGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 104 - protein, 258 aa, Artificial Sequence
  scFv protein NGF0502
QLQLQESGPGLVKPSQTLSLTCTVSGGSISSGDYYWSWIRQPPGKGLEWIGYIYYSGSTYYNPSLRSRLTISVDTSKNQFSLNLNSVTAADTAVYYCARDPPPNIAALSSGYYYMDVWGRGTLVTVSSGGGGSGGGGSGGGGSALDIQLTQSPDFLAVSLGERATLKCKASQTVLSSSNKKNFLAWYQQKPGQAPRLLFFWASMREFGVPDRFAGSGSGTDFTLTISSLQTEDVGIYFCQQYYSTPTFGGGTRLEIKR

SEQ ID NO: 105 - protein, 249 aa, Artificial Sequence
  scFv protein NGF0503
QVQLVQSGAEVKKPGSSVKVSCKGSGDTFSISGFSWVRQAPGQGLEWMGGISPLLGTPKYAQKFQGRVTITADESTSAVYMEMSSLRSEDTAVYFCAKTSFVVAPDGTGYLDYWGRGTLVTVSSGGGGSGGGGSGGGGSALDIQLTQSPSTLSASVGDRVTIACRASQSVSRSLAWYQQKPGKAPKLLIYDASRLESGVPSRFSGSGFGTEFTLTITSLQPDDFATYYCQQYKGYSGTFGQGTRLEIKR

SEQ ID NO: 106 - protein, 248 aa, Artificial Sequence
  scFv protein NGF0532
EVQLVQSGAEVKRPGASVKVSCKTSGYTFTNFGLSWVRQAPGQGLEWLGWISGSNTDTKYAQRVQGRLTMTTDTSTSTAYMELRSLTSDDTAVYYCARDHSQPMLYSPDYWGRGTLVTVSSGGGGSGGGGSGGGGSAQTVVIQEPSFSVSPGGTVTLTCGLSSGAVSSTHHPSWYQHTPGQPPRTLIYSTHIRSSGVPDRFSASILGNKAALTITGAQADDESNYFCVLYMGFGTWVFGGGTKVTVLG

SEQ ID NO: 107 - protein, 254 aa, Artificial Sequence
  scFv protein NGF0577
QVQLQQSGAEVKKPGASVKVSCKASGYTFSAYAIHWVRQAPGQRLEWVGRASGGNYNRKYSQKLQDRVTFTSDTSATTAYMELSSLTSEDTAVYYCVREDHDYDLWSDYKGLDVWGRGTLVTVSSGGGGSGGGGSGGGGSAQSALTQPASVSGSPGQSITISCTGISGGIGAHNLVSWYQQHPGEAPTLMIFEDTKRPSGVSNRFSGSKSGNTASLTISALQTEDEADYYCFSYPRSGGGMLGFGGGTKVTVLG

SEQ ID NO: 108 - protein, 259 aa, Artificial Sequence
  scFv protein NGF0746
EVQLVETGGRRGPAWEVTETLLCSVWFHLAADMAYTGSARLQARGLEWVALIFYDGSHRYYADSVKGRFTISRDNSKNTLSLQMNSLRVEDSAVYYCVRARSRFGSGSYKNIDLELFYLDNWGRGTLVTVSSGGGGSGGGGSGGGGSALEIVLTQSPGTLSLSPGERATLSCRASQSVDSTYLAWYQQRPGQAPRVLIYGGSSRATGIPDRFSGSGSGTDFILTISRLQPEGFAVYYCEHYGSPPRITFGQGTRLEIKR

SEQ ID NO: 109 - protein, 253 aa, Artificial Sequence
  scFv protein NGF0770
QVQLQESGGGLVQPGGSLRLSCGASGFTFRSYWMHWVRQVPGKGLAWVSRINSDGSSTWYADSVKGRLTTSRDNAKNTLYLQMNSLRIEDTAVYYCARGDPEELRSDSYFYYGMDVWGRGTLVTVSSGGGGSGGGGSGGGGSAQAVVIQEPSLTVSPGGTVTLTCSSSTGAVASGHSPTWFQQKYGQEPRTLIYSSIIKHSWTPARFSGSLLGGKAALTLSGVQPEDEADYYCLLYFGDGWVCGGGTQLTVLS

SEQ ID NO: 110 - protein, 248 aa, Artificial Sequence
  scFv protein NGF0788
QVQLVQSGGGLVKPGGSLRLSCAASGFTFSRYSMNWVRQAPGKGLEHVSAIIANGDSTYYTNSVKGRFTISRDNSKNRLYLQMGSLRPEDTAVYYCVRDGPGGQWGAFDIWGKGTLVTVSSGGGGSGGGGSGGGGSAQAVVIQEPSLSVSPGGTISLTCGLASGSVSSNHHPSWYQQTPGHTPRTLIYSATTRSTGVPDRFSGSILGNKAALTITGAQTEDESDYYCMLYLGPGIWVFGGGTKVTVLG

SEQ ID NO: 111 - protein, 248 aa, Artificial Sequence
  scFv protein NGF0808
QVQLQESGGGVVQPGKSLRLSCAASGFAFSRSSMHWVRQAPGKGLEWVSVISYDGSIKYYADSVKGRFTISRDNSKNTMYLQMNSLRPEDTAVFYCARPLQGIPAAGLDYWGRGTMVTVSSGGGGSGGGGSGGGGSAQSVLTQPPSVSAAPGQKVTISCSGISSNIGNNHVSWYQQFPGTAPKLLIYDSNKRPSGIPDRFSGSKSGTSATLDITGLQTGDEADYYCGTWDNSLSAGVFGGGTKLTVLG

SEQ ID NO: 112 - protein, 260 aa, Artificial Sequence
  scFv protein NGF0825
QVQLQESGPGLVKPSETLSLTCTVSPVSVSSGGYYWSWIRQPPGKGLEWIGYVFINGTTNYSPSLKSRVAISLDMSKNQFSLRLRSVTAAGTAVYYCARDNRDYYPSGSFGSGLSGYFYYYMDVWGRGTLVTVSSGGGGSGGGGSGGGGSALEIVLTQSPGTLSLSPGERATVSCRASQSVNSNYLAWYQQIPGQAPRLLIYGASSRATGIPDRFSGSGSGTDFTLTISRLEPEDFAVYYCQQYGSSPTFGQGTRLEIKR

SEQ ID NO: 113 - protein, 244 aa, Artificial Sequence
  scFv protein NGF0954
EVQLVETGGGLVQPGGSLRLSCAASGFTVSTDYMSWVRQAPGKGLEWVSVIYPGGITCYADSVKGRFSISRESSKNTVYLQMNSLRAEDTAIYYCAREVADYYGMDVWGQGTLVTVSSGGGGSGGGGSGGGGSALEIVLTQSPATLSLSPGERATLSCRASQNVNIYLAWYQQKPGQPPRVLIYDASKRATGIPARFSGSGSGTDFTLTISSLEPEDFAVYYCQQRFDWPPITLGQGTRLEIKR

SEQ ID NO: 114 - protein, 259 aa, Artificial Sequence
  scFv protein NGF1A05
EVQLVQSGGGLVQPGGSLRLSCAASGFGFSSYWMNWVRLAPGKGLEWVASIKQDGSEMFYVDSVKGRFTISRDNAKNSLSLQMNSLRAEDTAVYYCARDLVRITLVGVITKSYGMDVWGRGTMVTVSSGGGGSGGGGSGGGGSALDVVMTQSPDSLAVSLGERATINCKSSQSVLYSSNNQNYLAWYQQRPGQPPKMLIYGASTRASGAPDRYSGGGSGTDFTLTISSLQPEDVAVYYCQQYYSLPITFGQGTRLEIKR

SEQ ID NO: 115 - protein, 254 aa, Artificial Sequence
  scFv protein NGF1B02
EVQLVQSGAEVKKPGSSVKVSCKASGDTSSEYSITWVRQVPGQGLEWMGGIIPIFGATYYAQNFQGRVTISADESTSTAYMELGSLRSGDTAVYYCATVIPPTIGGVTHDSEGMDVWGRGTLVTVSSGGGGSGGGGSGGGGSAQSVLTQPPSASGTPGQRVTISCSGSSSNIGSNYVYWYQQLPGTAPKLLIYRNNQRPSGVPDRFSGSKSGTSASLAISGLRSEDEADYYCAAWDDGHNGWVFGGGTKVTVLG

SEQ ID NO: 116 - protein, 255 aa, Artificial Sequence
  scFv protein NGF1B03
EVQLVQSGAEVKKPGESLRISCKGSGYSFSSYWISWVRQVPGKGLEWMGRIDPSDSYTNYSPSFQGHVTISADKSISTAYLHWSSLKASDTAMYYCATLASADTGMVTDYKYYDMDVWGRGTLVTVSSGGGGSGGGGSGGGGSAQSVVTQPPSVSAAPGQKVTISCSGSNSNIGKNYVSWYQQLPGTAPKLLISDNNARPSGIPDRFSGSKSGASGTLDITGLQTGDEAAYYCKSWDSSLRAEVFGGGTKLTVLG

SEQ ID NO: 117 - protein, 250 aa, Artificial Sequence
  scFv protein NGF1B09
EVQLVQSGAEVKKSGSSVKVSCKASGDIFTNYAINWVRQAPGQGLEWMGRILPLFGTTNYAQRFQGRITITADESTGTAYMELSSLKSDDTAVYYCARPLSGDYYDTSGYHWWGKGTLVTVSSGGGGSGGGGSGGGGSAQSVLTQPPSASGTPGQRVTISCSGRSGNIGTNAVNWYQQLPGAAPKLIIYSNSQRPSGVPHRFSASRSGTSASLAISGLQSEDEADYYCSAWDDSLDGVVFGGGTKVTVLG

SEQ ID NO: 118 - protein, 252 aa, Artificial Sequence
  scFv protein NGF1C10
EVQLVQSGAEVKKPGESLKISCKGSGYNITNHWIAWVRQMPGKGLEWMGMIYPDDSDTRYSPSFQGQVTMSADKSINTAHLQWRSLKASDTAMYYCARHAHYDGSGYYYFDYWGKGTMVTVSSGGGGSGGGGSGGGGSAQSVLTQPPSVSGAPGQRVTISCTGSRSNIGAGYDVHWYQQLPGTAPKVLIFGNSNRPSGVLDRFSGSKSGTSASLAITGLQAEDEADYYCRSYDSSMSGSRVFGTGTKVTVLG

SEQ ID NO: 119 - protein, 249 aa, Artificial Sequence
  scFv protein NGF1D09
QLQLQESGSGLVKPSQTLSLTCAVSGGSISSGDYSWSWIRQPPGKGLEWIGYIYHSGSTYYNPSLKSRVTISIDRSKNQFSLKLSSVTAADTAVYYCARVGDYKEIDAFDIWGKGTLVTVSSGGGGSGGGGSGGGGSAQPVLTQPPSASGTPGQRVTISCSGSSSNIGTNTVNWYQQLPGTAPKLLIYSNTQRPSGVPDRFSGSKSGTSASLAISGLQSEDEADYYCGAWDDSLISGVFGGGTKLTVLG

SEQ ID NO: 120 - protein, 247 aa, Artificial Sequence
  scFv protein NGF1E09
EVQLVETGAEVRKPGSSVKVSCKASGGIFKKYAFSWVRQAPGQGLEWLGRTIPSIGNNNYIQSLKGRVTLTADESTNTVYMDLRNLRSEDTAIYFCAGAPKRFGESPNLWGRGTLVTVSSGGGGSGGGGSGGGGSAQAVVIQEPSLSVSPGGTVTLTCGLSSGSVSTTNYPTWYQQTPGQSPRTVIYDTYTRSSGVPDRFSGSILGNKAALTITGAQADDESDYYCAFYLGEGISVFGGGTKLTVLG

SEQ ID NO: 121 - protein, 250 aa, Artificial Sequence
  scFv protein NGF1G03
QVQLQESGPGLVKPSETLSLTCTVSGDSIGSSIYYWAWIRQPPGKGLEWIGRIYYSGTTNYNPSLKSRVTMSVDTSKNQFSLKLSSVTAADTAVYYCARSKGTKWERREFDYWGRGTMVTVSSGGGGSGGGGSGGGGSAQAVLTQPSSASGTPGQTVTISCSGSSSNIGSNPAHWYQQFPGTAPTLIIYYDGRRPSGVPDRFSGSKSGTSASLAISGLQSEDEADFYCASWDDNLNEYVFGTGTKVTVLG

SEQ ID NO: 122 - protein, 256 aa, Artificial Sequence
  scFv protein NGF1H02
QVQLVQSGGGLLQPGRSLRLSCAGSGFSFRDHALSWFRQAPGKGLEWVGFIRSKGYGGTTEYAASMAGRLNISRDDSKSIAYLQVNSLKTEDTAVYYCSRDSDYYASSGMGYAFDMWGKGTMVTVSSGGGGSGGGGSGGGGSAQAVLTQPSSVSGAPGQRVTIPCTGSSSNIGAGYGVHWYQQLPGTAPKLLIYDSDKRPSGVPDRFSGSKSGSSGSLAITGLQPEDEADYYCQSYDSSLSGSNVFGTGTKVTVLG

SEQ ID NO: 123 - protein, 241 aa, Artificial Sequence
  scFv protein NGF1H06
QVQLQQSGPGLVKPSETLSLTCTVSGDSITSYYWSWVRQPPGKTLEWIGYIFDTRTTKYNPSLKSRVTISADTSKNQFSLKLSSVTAADTAVYYCARDAGTIFDYWGQGTMVTVSSGGGGSGGGGSGGGGSAQSVLTQPPSVSVAAGQTARITCGEANIGRRSVHWYQRRPGQAPLMVIYYDTARRSGIPERFSGSNSGDTATLTISRVEAGDEADYYCQAWDFSSDHPVFGGGTKVTVLG

SEQ ID NO: 124 - protein, 256 aa, Artificial Sequence
  scFv protein NGF2C06
EVQLVQSGAEVKKPGESLRISCKGSGYSFSSYWISWVRQVPGKGLEWMGRIDPSDSYTNYSPSFQGHVTISADKSISTAYLHWSSLKASDTAMYYCATLASAYTGMVTYYKYYDVDVWRRATLATVSSGGGGSGGGGSGGGGSAQAVLTPPSSVFGAPGQRVTISCTGSNSNIGAGYDAHWYQQFPGSAPKLLIYGNTNRPSGVPDRFSGSKSGTSASLAITGLQAEDEADYYCQSYDTSLSSYVFGTGTQLTVLS

SEQ ID NO: 125 - protein, 253 aa, Artificial Sequence
  scFv protein NGF2D02
EVQLVQSGAEVKKPGSSVKVSCKASGGTLSSYAINWVRQAPGQGLEWMGQIIPMFGTMNYAQKFQGRVTISADESTGTAYMELSSLRYDDTATYYCAREVSGTRNYYYYGLDVWGQGTLVTVSSGGGGSGGGGSGGGGSAQAVLTQPSSVSGAPGQRVTIPCTGSSSNIGAGYDVHWYQHLPGTAPKLLIYGNINRPSGVPDRFSGSKSGTSASLAITGLQAEDEADYYCQSYDNRLSVSVVFGGGTQLTVLS

SEQ ID NO: 126 - protein, 258 aa, Artificial Sequence
  scFv protein NGF2D08
QLQLQESGPGLVKPSETLSLTCDVSGSSISSAYYWGWVRHSPGKGLEWIGSSYNNGPAYYNPSLIRRVTTSRDTSKNQVSLKMTSMTAADTAVYYCARGLRDSSGYYFGGYYFDLWGQGTLVTVSSGGGGSGGGGSGGGGSAQAVLTQPSSLSASPGALASLTCTLRSGINVTSYRIYWHQQKPGSPPQYLLRYKSDSDKQQGSGVPSRFSGSKDASANAGILLISGLQSEDEADYYCLIWHNSAVVFGGGTKLTVLG

SEQ ID NO: 127 - protein, 258 aa, Artificial Sequence
  scFv protein NGF2E08
QVQLQESGPGLVRPSETLSLTCTVSGSSVTSPYYWAWVRQPPGKALEWIASIYHSGSTHYNPSLKSRVTVSMDTSNNRFSLKVTSVTVTDTAVYYCARHASSYYGSFVQYHYYGLQVWGKGTLVTVSSGGGGSGGGGSGGGGSALVVVMTQSPVSLPVTRGQPASISCRSTEGLVYSDGNTYLNWFQQRPGQPPRRLVYQVSRRDPGVPDRFSGSGSGTDFTLEISRVEAEDLGIYFCMQGTHWPYTFGQGTKVEIKR

SEQ ID NO: 128 - protein, 245 aa, Artificial Sequence
  scFv protein NGF2E11
QVQLVQSGGGVVQPGRSLRLSCAASGLSFSSYGMHWVRQAPGKGLEWVAVIWFDGSNKYYADSVKGRFTISRDTSKNTLYLQMNSLRVEDTAVYYCAGEVRGSFGEFDYWGRGTMVTVSSGGGGSGGGGSGGGGSAQSVLTQPPSVSVAPGKTARITCGGNNVESKSVQWYQQKSGQAPVLVIYYNSYRPSGIPERFSGSNSGNTATLTISRVEAGDAADYYCQVWDSTTDHYVFGSGTKVTVLG

SEQ ID NO: 129 - protein, 247 aa, Artificial Sequence
  scFv protein NGF2F11
QVQLVESGGGLVQPGGSLRLSCAASGFTFSSYWMSWVRQAPGKGLEWVANIKQDGSEKYYVDSVKGRFTISRDNAKSSLYLQMNSLRAEDTAVYYCARPQEPPSSLIAHWGQGTMVTVSSGGGGSGGGGSGGGGSAQSVVTQPPSVSAASGQKVTISCSGRTSNIGNNYVSWYQQIPGTAPKLLLYDNNKRPSGIPDRFSGSKSGTIAILGITGLQTGDEADYFCGVWDSSLSSYVFGSGTKVTVLG

SEQ ID NO: 130 - protein, 254 aa, Artificial Sequence
  scFv protein NGF2G02
EVQLVESGGGLVQPGGSLRLSRAASGFTFTGYYMNWVRQAPGKGLEWVSSISTSSSTIYYADSAKGRFTTSRDNAKNSLYLQMNSLRAEDTAVYYCARGRGSYYFDSSGPPGYLDLWGQGTMVTVSSGGGGSGGGGSGGGGSAQSVVTQPPSASGAPGQRVAISCSGSYSSVGVNAVNWYQHLPGTAPKLLIYGTSQRPSGVPDRFSGSKSGTSASLAISGLQSEDEAEYYCQSYDRSLRAHVFGTGTKLTVLG

SEQ ID NO: 131 - protein, 255 aa, Artificial Sequence
  scFv protein NGF2G10
EVQLVESGAEVKKPGASVKVSCKTSGYIFSTYGITWVRQAPGQGLEWMGWISSKNGNTNYAQKFQGRVTMTTDTSTSTAYMELSSLTSDDTAVYYCARDSAYYYDSSGIGNWFDPWGKGTLVTVSSGGGGSGGGGSGGGGSAQAVLTQPSSVSGAPGQRVTISCTGSSSNIGAGYDVHWYQKLPDTGPKLLIFGNVIRPSGVPDRFSGSKSGTSASLAITGLQAEDEAEYFCQSYDTTLSGSVVFGGGTKLTVLG

SEQ ID NO: 132 - protein, 249 aa, Artificial Sequence
  scFv protein NGF3B08
QVQLQESGGGLVQPGGSLRLSCAASGFTFSSYAMSWVRQAPGKGLEWVSAISGSGGSTYYADSVKGRFTISRDNSKNTLYLQMNSLRAEDTAVYYCAKDPDGDPYWYFDLWGKGTLVTVSSGGGGSGGGGSGGGGSAQAVLTQPSSVSGAPGQRVTISCTGSSSNIGAAYDVHWYQHLPGTAPRVLIYANSNRPSGVPGRFSGSKSGTSASLAITGLQAEDEADYYCQSYDSSLSGYVFGTGTKLTVLG

SEQ ID NO: 133 - protein, 249 aa, Artificial Sequence
  scFv protein NGF3D11
EVQLVESGAEVKKPGSSVKVSCHVSGGTFGGNAFNWVRQAPGQGLEWMGRVIPIYGTSNYAQRFQGRVSITADESTDTAYMELSSLTSDDTAIYYCARDPGSGPYLSYFDSWGRGTLVTVSSGGGGSGGGGSGGGGSAQAVLTQPSSASGTPGQRVTISCSGTYSNIASNTVNWYQQLPGTAPKLLIYNNRQRPSGVPDRFSGSKSGTSASLAISGLQSEDETDYFCAAWDDALNGYVFGTGTKVTVLG

SEQ ID NO: 134 - protein, 250 aa, Artificial Sequence
  scFv protein NGF3H03
EVQLVETGGGVVQPGRSLRLSCAASGFGFRNSAMHWVRQAPGKGLEWVALIWSDGITKFYADSVKGRLTVSRDNSESTLYLQINSLRDEDTAVYYCARDGHYSVGFGFDVWGQGTMVTVSSGGGGSGGGGSGGGGSALNFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNQGVFGGGTKLTVLG

SEQ ID NO: 135 - protein, 253 aa, Artificial Sequence
  scFv protein NGG2002
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARAPHYDLWSKYYFRGMDVWGRGTMVTVSSGGGGSGGGGSGGGGSAQPVLTQPPSASGTPGQRVTISCSGSSSNIGRNTVNWYQQLPGTAPKLLLYNNDQRPSGVPDRFSGSKSGTSASLAISGLQSEDEADYYCSARDDSLNGYVFGTGTKVTVLG

SEQ ID NO: 136 - protein, 250 aa, Artificial Sequence
  scFv protein NGG2004
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREGGILGAVDVFDIWGRGTLVTVSSGGGGSGGGGSGGGGSAQSVLTQPPSVSGAPGQGVSISCTGTTSDIGAGYTVQWYQQFPGTAPKLLIYDDYRRPSGVPERFSGSKSGTSASLAITGLRTEDEADYYCQSYDNSLKNVVFGGGTKLTVLG

SEQ ID NO: 137 - protein, 245 aa, Artificial Sequence
  scFv protein NGG2007
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKEGSLDGYFDYWGKGTLVTVSSGGGGSGGGGSGGGGSALSSELTQDPTVSVALGQTVRISCQGDSLRSYYANWYQQKPGQAPLLVMYDTSNRPSGIPDRFSGSSSGNTASLTITGAQAEDEAEYFCSSRDISDKLLVFGGGTKLTVLG

SEQ ID NO: 138 - protein, 247 aa, Artificial Sequence
  scFv protein NGG2017
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREGHFDYVWGSFSLWGQGTTVTVSSGGGGSGGGGSGGGGSALSYVLTQPPSVSVSPGQTTSVICSGNKLEDKYVSWYQQKPGQSPVLVIYQDATRPSGIPERFSASNSGNTATLTISGTQAIDEADYYCQVWDSSTGVVFGGGTKLTVLG

SEQ ID NO: 139 - protein, 255 aa, Artificial Sequence
  scFv protein NGG2022
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARDPVGGSYDFWSGSLPIFDYWGRGTMVTVSSGGGGSGGGGSGGGGSAQPVLTQPPSASGTPGQRVTISCSGSSSNIASNTVNWYQQLPGTAPKLLIYSTNLRPSGVPDRFSGSKSGTSASLAISGLQSEDEGDFYCATWDGSLKGWVFGGGTKVTVLG

SEQ ID NO: 140 - protein, 256 aa, Artificial Sequence
  scFv protein NGG2043
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCATLASADTGMVTDYKYYDMDVWGRGTMVTVSSGGGGSGGGGSGGGGSAQAVLTQPSSVSGAPGQRVTISCTGGSSNIGAPNAVHWYQHLPGTAPKLLIFDNNIRPSGVPGRFSGSKSGTSASLAITGLQVDDEADYYCQSFDNSLDGWVFGGGTKVTVLG

SEQ ID NO: 141 - protein, 247 aa, Artificial Sequence
  scFv protein NGG2051
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARHDILFPYVDVWGRGTTVTVSSGGGGSGGGGSGGGGSALNFMLTQPHSVSESPGKTVTISCTRSSGSIASNHVQWYQQRPGSSPTIVIYEDNLRPSGVPDRFSGSLDSSSNSASLTISGLKTEDEADYYCQSYDSSTVLFGGGTKVTVLG

SEQ ID NO: 142 - protein, 244 aa, Artificial Sequence
  scFv protein NGG2053
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREMAYGDFDHWGRGTTVTVSSGGGGSGGGGSGGGGSALSYVLTQPPSVSVAPGETARIACGGNNIGSESAHWYQQKPGQAPLLVIYYDSGRPSGIPERFSGSNSGNTATLTITRVEAGDEADYYCQMWDSSSDHWVFGGGTKVTVLG

SEQ ID NO: 143 - protein, 255 aa, Artificial Sequence
  scFv protein NGG2071
EVQLFESGGGLVQPGGSLRLSCAASGFTFSSYAMSWVRQAPGKGLEWVSAISGSGGSTYYADSVKGRFTISRDNSKNTLYLQMNSLRAEDTAVYYCATLASADTGMVTDYKYYDMDVWGRGTTVTVSSGGGGSGGGGSGGGGSAQTVVIQEPSLSVSPGGTVTLTCDLNSASVSTNHNPSWYQQTPGQAPRTLIYNTNTRSSGVPDRFSGSILGNKATLTITGAQADDESIYYCALYMGSGIVVFGGGTKLTVLG

SEQ ID NO: 144 - protein, 246 aa, Artificial Sequence
  scFv protein NGG2086
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREISSVPNWFDPWGRGTLVTVSSGGGGSGGGGSGGGGSALSSELTQDPAVSVALGQTVRITCQGDSLRNYYASWYQQKPGQAPLLVIYAKDIRPSGIPDRFSGSRSGTTASLTITGAQAEDEADYYCNSRDTTGKHPVFGGGTKVTVLG

SEQ ID NO: 145 - protein, 246 aa, Artificial Sequence
  scFv protein NGG2103
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCALHYYGLGSFDFWGRGTLVTVSSGGGGSGGGGSGGGGSAQSVLTQPPSVTGVPGQRVTISCSGSTSMIERADISWYQQLSGEAPKLLVFANVVPSSGVSDRFSASKSGTSASLAISALRSGDEGDYYCAAFHDGLNDWVFGGGTKLTVLG

SEQ ID NO: 146 - protein, 247 aa, Artificial Sequence
  scFv protein NGG2105
EVQLLESGGGLVQPGGTLRLSCATSGFTFSSYAMSWVRQAPGKGLDWVSAISGSGGSTYYSHSVKGRFTISRDNSKNTLYLQMNSLRAEDTAVYYCAREGHFDYVSGSFSLWGQGTTVTVSSGGGGSGGGGSGGGGSALSYVLTQPPSVSVSPGQTTSVICSGNKLEDKYVSWYQQKPGQSPVLVIYQDATRPSGIPERFSASNSGNTATLTISGTQAIDEADYYCQVWDSSTGVVFGGGTKLTVLG

SEQ ID NO: 147 - protein, 244 aa, Artificial Sequence
  scFv protein NGG2123
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDQSWGTFDYWGRGTLVTVSSGGGGSGGGGSGGGGSAQSVLTQPPSVSVAPGQTARMTCGGDNIGTRTVHWYQQKPGQAPVLVIFYDSARPSGIPERFSGSNSGNTATLTISRVEAGDEADYYCQVWTTTSDHQWVFGGGTKLTVLG

SEQ ID NO: 148 - protein, 253 aa, Artificial Sequence
  scFv protein NGG2251
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAREEYYGSDIFLGNAFDIWGQGTLVTVSSGGGGSGGGGSGGGGSAQSVLTQPPSVSGALGQRVTISCSGSNSNIGAGYDLNWYQQLPGTAPKLLIYGNANRPSGVPDRFSGSKSGTSASLAITGLRADDEAHYYCQSYDNRLSGVIFGGGTKLTVLG

SEQ ID NO: 149 - DNA, 723 bp, Artificial Sequence
  CDS (1)..(723): Polynucleotide encoding NGE2005 scFv protein
gagggcagctggtggagtctgggggaggcttggtcaagcctgggagggtccctgagactctcctgtgcagcctctggattcaccttcagtgactactacatgagctggatccgccaggctccagggaaggggctggagtgggtttcatacattagtagtagtggtggtaccatatattacgcagactctgtgaagggccgattcaccttctccagggacaacgccaagaactcactgtatctgcaaatgaacagtctgagagccgaggacacggctgtttattactgtgcgagaggtttggagaggcactacgtggacgtctggggcaaagggacaatggtcaccgtctcctcaggtggaggcggttcaggcggaggtggcagcggcggtggcggatcgtctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaaccatgtggtattcggcggagggaccaagctgaccgtcctaggt

SEQ ID NO: 150 - DNA, 744 bp, Artificial Sequence
  CDS (1)..(744): Polynucleotide encoding NGE2077 scFv protein
gaggtgcagctggtgcagtctggggctgaggtgaagaagcctgggtcctcggtgaaagtctcctgcaaggcttctggagacaccttcagcagctttggtttcagctgggtgcgacaggcccctggacaagggcttgagtggatgggagggatcatccctatgtatggaacagcaaagtatgcacagaagttccaggacagagtcacgattaccgcggacgaatccatgagcacagtctacatggagctgaacagcctgagatctgacgacacggccgtgtattattgtgcgcgaggacctctagttcgctactatttctactacatggacgtctggggcagagggacaatggtcaccgtctcgagtggtggaggcggttcaggcggaggtggcagcggcggtggcggatcgcagtctgtgctgactcagccaccctcagcgtctgggacccccgggcagagggtcaccatctcttgttctggaagcagctccaacatcgggagtaacactgtaaactggtaccagcgactcccaggagcggccccccaactcctcatctacaataatgaccagcggccctcagggatccctgaccgattctctggctccaggtctggcacctcaggctccctggtcatcagtgggctccagtctgaagatgaggctgattactactgtgcgtcatgggatgacagtctgaatggtcgggtgttcggcggagggaccaagctgaccgtcctaggt

SEQ ID NO: 151 - DNA, 741 bp, Artificial Sequence
  CDS (1)..(741): Polynucleotide encoding NGE2105 scFv protein
caggtgcagctggtgcaatctgggggaggcgtggtccagcctggggagtccctgagactctcctgtgcagcctctggattcacccttagcagctatgccatggcctgggtccgccaggctccagggaaggggctggagtggattggcaatatctattttggcgggagcgcctactataacccgtccctcaagagtcgagtcaccatatcactagccacgtccgagaaccagttctccctgaagctgacctctgtgaccgccgcggacacggccatgtatttctgtgcgagagagattaatgactacggtgactttggaggttatgatctgtggggccaagggacaatggtcaccgtctcttcaggtggaggcggttcaggcggaggtggcagcggcggtggcggatcgcagtctgtgctgactcagcctgcctccgtgtctgggtctcccggacagtcgatcaccatctcctgcactggaaccagcagtgacgttggtggttataactatgtctcctggtaccaacaacacccaggcaaaacccccaaactcatgatttatgagggcagtaagcggccctcagggatttctaatcgcttctctggctccaagtctggcaacacggcctccctgacaatctctgggctccaggctgaggacgaggctgattattactgcagctcatatacaaccaggagcactcgagttttcggcggagggaccaagctgaccgtcctaggt

SEQ ID NO: 152 - DNA, 750 bp, Artificial Sequence
  CDS (1)..(750): Polynucleotide encoding NGE2122 scFv protein
gaggtccagctggtgcagtctggagctgaggtgaagaagcctgggtcctcggtgaaggtctcctgcaaggcttctggaggcaccctcaggagttttgctatcagttgggtgcgacaggcccctggacaagggcttgagtgggtgggaaggatcatccctgtacttaacatagcagattatgctcagaagttccggggccgagtcacgcttaccgcggacgatttcacggacacagcctacatggagctgagcaggctgacatctgacgactcggccatatattactgtgcgaaagatcgagaaactgttacgactaactgggcgtactactttgactactggggccaagggacaatggtcaccgtctcttcaggtggaggcggttcaggcggaggtggcagcggcggtggcggatcgcagtctgccctgactcagcctgcctccgtgtctggatctcgtggacagtcgatcaccatctcctgcactggaaccactggtgacgttggtggttatgactatgtctcctggtaccaacagcacccaggcaaagcccccaaactcctcatctatggtaacagcaatcggccctcaggggtccctgatcgcttctctgcctccaagtccggcaatacggcctccctgaccatctctggactccaggctgaggatgaggctgattatttctgcagcacatatgcaccccccggtattattatgttcggcggagggaccaagctgaccgtcctaggt

SEQ ID NO: 153 - DNA, 765 bp, Artificial Sequence
  CDS (1)..(765): Polynucleotide encoding NGE2902 scFv protein
  misc_feature (93): n equals a,t,g, or c
  misc_feature (105): n equals a,t,g, or c
caggtgcagctggtggagtctgggggaggcgtggtccagcctgggaagtccctgagactctcctgtgaagcctctggattcacccttcagtanctatggcatgancgggtccgccaggctccagggaaggggctgactagggtttcatacattgatagtactgaaggtgtcatttactacgcagacactttccagggccgcttcaccatctccagagacaattccaagagcactgtgtacctgcacatgagcagcctgctccctgacgacgcgggtgtttattactgtgcgcgcgaacctgacaggggatactgttctgaaagtggctgctacactccctacttctttgactcctggggcagagggacaatggtcaccgtctcttcaggtggaggcggttcaggcggaggtggcagcggcggtggcggatcgcagtctgtgctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatcgctgggctccaggctgaggacgaggctgattattactgcagctcatatacaaccaggagcactcgagttttcggcggagggaccaagctgaccgtcctaggt

SEQ ID NO: 154 - DNA, 717 bp, Artificial Sequence
  CDS (1)..(717): Polynucleotide encoding NGE2925 scFv protein
caggtgcagctgcaggagtcgggcccaggactggtgaagccttcggagaccctgtccctcacctgcgttgtctctggtggctccatcagcagtagtaactggtggagctgggtccgccagcccccagggaaggggctggagtggattggggaaatctatcatagtgggagccccaactacaacccgtccctcaagagtcgagtcaccatatcagtagacaagtccaagaaccagttctccctgaagctgagctctgtgacctccgcggacacggccgtgtattactgtgcaagacagtgggaggggattcgttcttggggccaaggtaccctggtcaccgtgtcgagaggtggaggcggttcaggcggaggtggctctggcggtggcggatcgtctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcgggcggaagatgaggctgactattactgtaactcccgggacagcagtggtaaccatgtggtattcggcggagggaccaagctgaccgtcctaggt

SEQ ID NO: 155 - DNA, 750 bp, Artificial Sequence
  CDS (1)..(750): Polynucleotide encoding NGE3064 scFv protein
gaggtccagctggtgcagtctgggggaggcgtggtccagcctgggaggtccctgagactctcctgtgcagcctctggattcaccttcagtgactatggcatacactgggtccgccaggctccaggcaaggggctggagtgggtggcagctatattatatgatggaagtaatcaattctatacagactccgtgaagggccgattcaccctctccagagacatttccaagaacacactgtatctgcaaatgaacagcctgagagtcgaggacacggccgtatattactgtgtgagagatttagtagcagcagctggtaccggcctaccaataggctccgtctggggccgggggacaatggtcaccgtctcttcaggtggaggcggttcaggcggaggtggcagcggcggtggcggatcgcagtctgtgctgactcagcctgcctccgtgtctgggtctcctggacagtcgatcaccatctcctgcactggaaccagcagtgatgttggtggttataactatgtctcctggtaccaacagcacccaggcaaagcccccaaattcatgatttatgatgtcagtaagcggccctcaggggtttctaatcgcttctctggctccaagtctggcaacacggcgtccctgaccatctctggggtccaggctgaggacgaggctgattattactgcagctcatatacaagcgccagcactgtgatattcggcggagggaccaagctgaccgtcctaggt

SEQ ID NO: 156 - DNA, 768 bp, Artificial Sequence
  CDS (1)..(768): Polynucleotide encoding NGF0540 scFv protein
caggtgcagctgcaggagtcgggcccaggagtggtgaagccttcggagaccctgtccctctcctgcactgtctctggtgactccatcagcactagtgattactactggggctgggtccgccagcccccagggaaggggctggaatggattggcagtttattttatcgtgggaccacctactacagcccatccctcaagagtcgagtctccatatccgtggacacgtccaagaaccagttctccctgaacctaagctctgtgaccgcctcagacacggccgtgtatttctgtgcgagacatgcgcgttttggtcgacatgactaccttggcgagcgggatgtttttgatatctggggccgggggacaatggtcaccgtctcgagtggaggcggcggttcaggcggaggtggctctggcggtggcggaagtgcactttcctatgagctgactcagccaccctcagcgtctgggacccccgggcagagggtcaccatctcttgttctggaagcagccccaatatcggaagtaatactgtaaactggtaccaacagctcccaggaacggcccccaaactcctcatccatactaataatcagcggccctcaggtgtccctgaccgcttctctggctccaagtctggtacctcagcctccctggccatcagtgggctccagtctgaggatgaggctgattattactgtgcatcatgggatgacagcctgaatggtgtggtattcggcggagggaccaagctgaccgtcctaggt

SEQ ID NO: 157 - DNA, 741 bp, Artificial Sequence
  CDS (1)..(741): Polynucleotide encoding NGF0719 scFv protein
gaggtccagctggtgcagtctgggactgaggtgaaaaagcctggggcctcagtgaaggtttcctgcaaggcatctggatacaccttcagcagttattatatgcactgggtgcgacaggcccctggacaagggcttgagtggatgggagtgatcaaccctggtggtgatgtcacaggctacgcaccgaagttccaggacagagtcaccatgaccagggacacgtccacgagcacactctacatggagttaagtagcctgagatctgaggacacggccctatattactgtgcgagagactctgatactggctggttctccattgactactggggccggggcaccctggtcaccgtctcgagtggaggcggcggttcaggcggaggtggctctggcggtggcggaagtgcacaggctgtgctgactcagccgtcctcagtgtctgggacccccgggcagacggttatcatctcttgttctggaagcaactccaacatcagagggaatactgtgaactggtaccagcaactcccaggctcggcccccagactcctcatctatagtaataatatacggccctcaggggtccctgaccgattctctggctccaagtctgacacctcagcctccctggccatcagtgggctccagtctgaagatgaggctgatttttactgtgcaacatgggatgacagcctgaggggtttggtgatcggcggagggaccaagctgaccgtcctaggt

SEQ ID NO: 158 - DNA, 762 bp, Artificial Sequence
  CDS (1)..(762): Polynucleotide encoding NGF0936 scFv protein
caggtgcagctgcaggagtcgggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgctaccctgaatagtggctacgattataagtggggctactactactacggtatggacgtctggggccggggcaccctggtcaccgtctcgagtggaggcggcggttcaggcggaggtggctctggcggtggcggaagtgcacagcctgtgctgactcagccaccctcagcgtctggggcccccgggcagacggtcaccatctcttgttctggaagcagctccaacgtcggaagtaatactgtggactggtaccagcagctcccaggatcggcccccaagctcctcatctatactaatgatcagcggccctcaggggtccctgaccgattctctggctccaagtctggcacctcagcctccctggccatcagtgggctccagtctgaggatgaggctgattattactgttcaactagggatgacagactgaatggtcgggtattcggcggagggaccaagctgcccgtcctaggt

SEQ ID NO: 159 - DNA, 744 bp, Artificial Sequence
  CDS (1)..(744): Polynucleotide encoding NGF0947 scFv protein
caggtgcagctgcaggagtcggggggaggcttggtacagcctggagggtccctgagactctcctgtgcagcctctggattgaacctcagacaagaggaaatgaactgggtccgccagactccagagaaggggctggagtggatttcatatatcagtagtggcggaggttccagagactacgcagactctgtgaagggccgattcaccatctccagagacaacgccaagaatttaatgtatctgcaaatgaacaacctgagagccgaggatacggctgtttattactgtgcgagacaggaagcaggtcggtatgaggctcttgatatctggggccggggaaccctggtcaccgtctcgagtggaggcggcggttcaggcggaggtggctctggcggtggcggaagtgcacagtctgtgctgacgcagccgccctcagtgtctggggccccagggcagacggtcaccatctcatgcactggtaccacctccaacatcggggcaggttatgatgttcactggtaccagcaggttccaggaacagcccccaaagtcctcatttatggtagccgcaatcggccctcaggggtcccttatcgattctctggcttcaagtctggcacctcagcctccctggccatcactgggctccaggctgaggatgaggctgattattactgccaggcctatgacagcagcctgagtggatatgtcttcggaatggggacccagctcaccgttttaagt

SEQ ID NO: 160 - DNA, 765 bp, Artificial Sequence
  CDS (1)..(765): Polynucleotide encoding NGF1A04 scFv protein
gaggtgcagctggtggagactggggctgaagtgaagaagcctgggtcctcggtgaaggtctcctgcaaggcttctggaggcaccttcagcaactatgctgtcagctgggtgcgacaggcccctggacaagggcttgagtggatgggagggatcatccctatctttggtataccaaactacgcacagaagttccagggcagactcacgattaccgcggacgaatccacgagcacagcctacatggagctgagcagcctgagatctgaggacacggccatttattactgtgcgagaaagccgtacctgggtgggcggtatagtgccttcaccccgagctggttcgacccctggggccaaggcaccctggtcaccgtctcgagtggaggcggcggttcaggcggaggtggctctggcggtggcggaagtgcactttcctatgagctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgactattactgtgcagcatgggatgacagcctgaatggtgtggtattcggcggagggaccaagctgaccgtcctaggt

SEQ ID NO: 161 - DNA, 762 bp, Artificial Sequence
  CDS (1)..(762): Polynucleotide encoding NGF1C04 scFv protein
caggtacagctgcagcagtcaggcccaggcctggtgaggccctcacagaccctgtccctcgcctgcactgtctctggtgactccatcagcagtggtgattattactggacctggatccgccagcacccagggaagggcctggagtggattggatacatctctacccgtgggagcccctactacaatccgtccttcatgaatcgagtcgccatatcgatagactcgtctaagaaccaattctccctgaatctgagctctgtgactgccgcggacacggccgtctattactgtacgagagaaacacaacacacttcgatttttggagtgatccataactggctcgacccctggggccagggaaccctggtcaccgtctcgagtggaggcggcggttcaggcggaggtggctctggcggtggcggaagtgcacaggctgtgctgactcagccgtcctcagcgtctgggacccccgggcagagggtctccatctcttgttctggaagcagctccaacatcggaagtaatactgtaaactggtaccagcagctcccaggaacggcccccaaactcctcatctatagtggtaatcagcggccctcaggggtccctgaccggttctctggctccaagtctggcacctcagcctccctggccatcagtgggctccagtctgaggatgaggctgattattactgtgcagcatgggatgacagcctgaataatctggtcttcggacctgggaccaaggtcaccgtcctaggt

SEQ ID NO: 162 - DNA, 735 bp, Artificial Sequence
  CDS (1)..(735): Polynucleotide encoding NGF1E07 scFv protein
gaggtgcagctggtggagtccggggctgaggtgaagaagcctggggcctcagtgaaggtctcctgcaaagtttccggagacaccctcgcagaattaaccatgcactgggtgcgacaggctcctggaaatggccttgagtggatggggggctatgatcctgagtctggtgaaacaaagcacgcacagaaatttcagggcagagtcaccatgaccgaggacacatctacagacacagcctatatggaattgagcagcctgagatctgaggacacggccgtgtattactgtgcagcagatcgtcgacactggggaagtctggacgtctggggcaaaggcaccctggtcaccgtctcgagtggaggcggcggttcaggcggaggtggctctggcggtggcggaagtgcactttcctatgtgctgactcagccaccctcggtgtctgaagcccccgggcagagggtcaccatctcctgttctggaggcaacgtcggaagcagttctgttaactggtaccagcaactcccaggaaaggctcccacactccttatctattatgacactgttctgacctcaggggtctctgcccgattctctggctccaggtctgccacctcagcctccctggccatcagtgggctccagtctgaggatgaggctgactattattgtgcgatatgggatgacagcctaaatgcctgggtgttcggcggagggacccagctcaccgttttaagt

SEQ ID NO: 163 - DNA, 750 bp, Artificial Sequence
  CDS (1)..(750): Polynucleotide encoding NGF1G12 scFv protein
gaagtgcagctggtgcagtctggggctgaggtgaagaagccggggtcctcggtgaaggtctcctgcaaggcttctggagacaccttcagtagttatgcaatcacctgggtgcgacaggcccctggacaagggcttgagtggatgggagggatcatccccatctatggtacagcaaactacgcacagaagttccagggcagagtcacgattaccgcggacgaatctacgaacacagcctacatgaaactgagcagcctgagatctgaggacacggccgtgtattactgtgcgagagtcgtcggattacgactccgggacgctgcttttgatgcctggggccaggggacaatggtcaccgtctcgagtggaggcggcggttcaggcggaggtggctctggcggtggcggaagtgcactttcctatgtgctgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttatgtcttcggaactgggaccaagctgaccgtcctaggt

SEQ ID NO: 164 - DNA, 747 bp, Artificial Sequence
  CDS (1)..(747): Polynucleotide encoding NGF3C10 scFv protein
cagctgcagctgcaggagtcgggcccaggactggtgaagccttcggggaccctgtccctcacctgcgctgtcactggtgactccatcaccagtaataactggtggagttgggtccgccaggccccagggaaggggctggagtggattggggatgtctatcatactgggactacgaactataacccgtccctcaagagtcgagtcaccatatcagttgacgagtccaagaatcaattttccctgaaagtgacttctgtgaccaccgcggacacggccgtttattactgtgcgagagaagaatacgatgtttggagtggccccatggacgtctggggccagggcaccctggtcaccgtctcgagtggaggcggcggttcaggcggaggtggctctggcggtggcggaagtgcacaggctgtgctgactcagccgtcctcagtgtctggggccccagggcagagggtcagcatctcctgcactgggagcagctccaacatcggggcaggttatgatgtacattggtatcaacaacttccaggaacagcccccaaactcctcatctacggtaacatcaatcggccctcaggggtccctgaccgattctctggctccaagtctggcacctcagcctccctggccatcactgggctccaggctgaagatgaggctgattattactgccagtcctatgacagcagcctgagggctgcggtattcggcggagggaccaaggtcaccgtcctaggt

SEQ ID NO: 165 - DNA, 768 bp, Artificial Sequence
  CDS (1)..(768): Polynucleotide encoding NGG2208 scFv protein
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtgtattactgtgcgagagatcgtacttacgatttttggagtgggtacgataaccctgcggacttctacgccgctatggacgtctggggccggggaaccctggtcaccgtctcgagtggaggcggcggttcaggcggaggtggctctggcggtggcggaagtgcacttgacatccagttgacccagtctccatcttccgtgtctgcatctgtaggagacagagtcaccatgacttgtcgggcgagtcaggttattgacagttggttagcctggtatcagcagaaaccagggaaagcccctaagctcctggtctatgctgcatccagtttgcaaagtggggtcccatcaaggttcagcggcagtggatctgggacagatttcactctcacaatcagcagcgtacagcctgaagattttgcaacttactattgtcaacaggcttacagtttcccaatcaccttcggccaagggacacgactggagattaaacgt

SEQ ID NO: 166 - DNA, 738 bp, Artificial Sequence
  CDS (1)..(738): Polynucleotide encoding NGE2001 scFv protein
gaggtccagctggtacagtctggaggagtcgtggtacagcctggggggtccctgagactctcctgtgcagcctctggattcacctttgatgattatgccatgcactgggtccgtcaagctccggggaagggtctggagtgggtctctcttattagttgggatggtggtagcacctactatgcagactctgtgaagggtcgattcaccatctccagagacaacagcaaaaactccctgtatctgcaaatgaacagtctgagagctgaggacaccgccttgtattactgtgcaaaagatctgaattacgatttttggagtggttccggtatggacgtctggggccaaggcaccctggtcaccgtctcgagtggtggaggcggttcaggcggaggtggcagcggcggtggcggatcggatgttgtgatgactcagtctccatcctccctgtctgcatctctaggagacagagtcaccatcacttgccgggcaagtcaggacattacaaatgacttagcctggtatcagcagaaaccagggaaagcccctaaactcctgatctatggtgcatccactttgcaatatggggtcccaaccaggttcagcggcagtgggtctgggacaaacttttctctcactatcagcagcctgcagcctgaggattttgcaacttattactgccaacagtataatagttatcctctcactttcggcggagggaccaaggtggaaatcaaacgt

SEQ ID NO: 167 - DNA, 747 bp, Artificial Sequence
  CDS (1)..(747): Polynucleotide encoding NGE2014 scFv protein
caggtccagctggtgcagtctgggggagtcgtggtacagcctggggggtccctgagactctcctgtgcagcctctggattcacctttgatgattatgccatgcactgggtccgtcaagctccggggaagggtctggagtgggtctctcttattagttgggatggtggtagcacctactatgcagactctgtgaagggtcgattcaccatctccagagacaacagcaaaaactccctgtatctgcaaatgaacagtctgagagctgaggacaccgccttgtattactgtgcaaaagatctgaattacgatttttggagtagttccggtatggacgtctggggcaagggaaccctggtcaccgtctcctcaggtggaggcggttcaggcggaggtggcagcggcggtggcggatcgcagtctgtgctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaagcagcagcactctggtgttcggcggagggaccaagctgaccgtcctaggt

SEQ ID NO: 168 - DNA, 732 bp, Artificial Sequence
  CDS (1)..(732): Polynucleotide encoding NGE2061 scFv protein
caggtacagctgcagcagtcaggtccaggactggtgaagccctcgcagaccctctcactcacctgtgccatctccggggacagtgtctctagcaacagtgctgcttggaactggatcaggcagtccccatcgagaggccttgagtggctgggaaggacttactacaggtcgcagtggcataatgattttgcaccatttgtgcaaagtcgcatagccgtcaacccagacacatccaagaaccagttctccctgcacctgaagtttgtgactagcgaagacacggctgtctattactgcgcaagagaccctcccgatgatcaaggttttgatatctggggccggacaatggtcaccgtctcttcaggtggaggcggttcaggcggaggtggcagcggcggtggcggatcggatgttgtgatgactcagtctccatcctccctgtctgcatctgtaggagacagagtcgccatcacttgccgggccagtcagggcattagcaattatttagcctggtatcagcaaaaaccagggaaagcccctaagctcctgatctataaggcatctactttagaaagtggggtcccatcaaggttcagtggcagtggatctgggacagaattcactctcacaatcagcagtctgcaacctgatgattttgcaacttattactgccaacaatatagtaattatccgctcactttcggcggagggaccaagctggagatcaaacgt

SEQ ID NO: 169 - DNA, 738 bp, Artificial Sequence
  CDS (1)..(738): Polynucleotide encoding NGE2072 scFv protein
cagatgcagctggtgcaatctgggggaggcgtggtccagcctgggaggtccctgagactctcctgtgcagcctctggattcaccttcagtagctatggcatgcactgggtccgccaggctccaggcaaggggctggagtgggtggcaactatttggtatgatggaactaaatactactcagactccgtgaagggccgattcaccatttccagagacaattccaagaacacactgtatttggaaatgaacagtctgagaggcgaggacaccgctgtttattactgtgtgagaacctctactatagtgggagcaaaatcgtttgactactggggccgaggcaccctggtcaccgtctcgagtggtggaggcggttcaggcggaggtggcagcggcggtggcggatcgcagtctgtgctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcactcgagttttcggcggagggaccaagctgaccgtcctaggt

SEQ ID NO: 170 - DNA, 747 bp, Artificial Sequence
  CDS (1)..(747): Polynucleotide encoding NGE2108 scFv protein
caagtgcagctggtggagtctgggggaggcttggtacagcctggggggtccctgagactctcctgtgcaacctctggattcacctttgatgattatgccatgcactgggtccgtcaagctccggggaagggtctggagtgggtctctcttattagttgggatggtggtagcacctactatgcagactctgtgaagggtcgattcaccatctccagagacaacagcaaaaactccctgtatctgcaaatgaacagtctgagagctgaggacaccgccttgtattactgtgcaaaagatctgaattacgatttttggagtggtaccggtatggacgtctggggcaaaggcaccttggtcaccgtctcctcaggtggaggcggttcaggcggaggtggcagcggcggtggcggatcgcagtctgtgctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcactcgagttttcggcggagggaccaagctgaccgtcctaggt

SEQ ID NO: 171 - DNA, 741 bp, Artificial Sequence
  CDS (1)..(741): Polynucleotide encoding NGE2131 scFv protein
caggtcaccttgaaggagtctgggccaggactggtgaagccttcggagaccctgtccctcacctgcactgtctctggtggctccatcagcagtagtagttactactggggctggatccgccagcccccagggaaggggctggagtggattgggagtatctattatagtgggaacacctatgacaacccgtccctcaagagtcgactcaccatgtcagtagacacgtccaggaaccagttctccctgaagctgagttctgtgaccgccgcggacacggccgtgtattactgtgcgaggcaaaggtataacagtgcctggttcccttactactttgacctctggggcaggggaaccctggtcaccgtctcgagtggtggaggtggttcaggcggaggtggcagcggcggtggcggatcggacatccagatgacccagtctccttccaccctgtctgcatctattggagacagagtcaccatcacctgccgggccagtgagggtatttatcactggttggcctggtatcagcagaagccagggaaagcccctaaactcctgatctataaggcctctagtttagccagtggggccccatcaaggttcagcggcagtggatctgggacagatttcactctcaccatcagcagcctgcagcctgatgattttgcaacttattactgccaacgatatagtaattatccgctcactttcggcggagggaccaagctggagatcaaacgt

SEQ ID NO: 172 - DNA, 741 bp, Artificial Sequence
  CDS (1)..(741): Polynucleotide encoding NGE2132 scFv protein
  misc_feature (11): n equals a,t,g, or c
  misc_feature (37): n equals a,t,g, or c
  misc_feature (81): n equals a,t,g, or c
  misc_feature (111): n equals a,t,g, or c
cagtgcagctncagagtcggggggagccgtgtccagnctgggaggtccttgaaactctcctgtgcagcctctggactaccnttcagaaactatggcatgcactgggtccgnccagctccgggcaagggctgggagtgggcggcatttatatcatatgaaggaagtaataaatattatgtagactccgtgaagggcgatttcaccgtctccagagacaatcccaagaacacgctgtatttgcaaatgaacagcctgagaggtgacgacacggctgcgtattattgtgcgaagatgggggcccacttcggctacgaccactacatggacgtctggggccaaggaaccctggtcaccgtctcctcaggtggaggcggttcaggcggaggtggcagcggcggtggcggatcgcagtctgtgctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcactcgagttttcggcggagggaccaagctgaccgtcctaggt

SEQ ID NO: 173 - DNA, 750 bp, Artificial Sequence
  CDS (1)..(750): Polynucleotide encoding NGE2164 scFv protein
gaggtgcagctggtgcagtctgggggaggcttgctacagcctggcaggtccctgagactctcctgtgcagcctctggattcaccttcagtagctatagcatgaactgggtccgccaggctccagggaaggggccggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagcttcccctgctactttggagtggttattcccgtactactactacatggacgcctggggcagaggaaccctggtcaccgtctcctcaggtggaggcggttcaggcggaggtggcagcggcggtggcggatcggacatcgtgatgacccagtctccttccaccctgtctgcatctgtaggagacagagtcaccatcacttgccgggccagtcagggtattagtagctggttggcctggtatcagcagagaccagggagagcccctaaggtcttgatctataaggcatctactttagaaagtggggtcccatcaaggttcagcggcagtggatctgggacagatttcactctcaccatcagcagtctgcaacctgaagattttgcaacttactactgtcaacagagttacagtaccccgtggacgttcggccaagggaccaagctggagatcaaacgt

SEQ ID NO: 174 - DNA, 750 bp, Artificial Sequence
  CDS (1)..(750): Polynucleotide encoding NGE2258 scFv protein
cagatgcagctggtgcagtctgggggtggcttggtcaagtctggagggtccctgagactctcctgtgcagcctctggattcaccttcagtgactactacatgagctgggtccgtcaggctccagggaaggggctggagtggatttcatacattagtagtagtggttctatcatatattatgcagactctgtgaggggccgattcaccatctccagggacaacgccgacaactcactgtatctgcacatgaacagcctgagagccgatgacacggccgtgtattactgtgcgagagacccccagggttatactgccacccgggacagctggttcgacccctggggccaggggacaatggtcaccgtctcttcaggtggaggcggttcaggcggaggtggcagcggcggtggcggatcgcagtctgtgctgactcagcctgcctccgtgtccgggtctcctggacggtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcactcgagttttcggcggagggaccaagctgaccgtcctaggt

SEQ ID NO: 175 - DNA, 729 bp, Artificial Sequence
  CDS (1)..(729): Polynucleotide encoding NGE2281 scFv protein
cgaggtgcagctggtggagactgggggaggtgtggtcagcctgggaggtccctgagactctcctgtgcagcctctggattcaccgtcagtagcacgtacatgagctgggtccgccaggctccagggaaggggctggaatgggtctcggttctttatagtggtggtactacagcctacgcagactccgtgattgaccgatccaccatctccagagacaatgccaagaactcactgtatctgcaaatgaacagcctgagagacgaagacacggctgtgtattactgtgcgagagatttcgagtataaggtttttgatatctggggccggggaaccctggtcaccgtctcgagtggtggaggcggttcaggcggaggtggcagcggcggtggcggatcgcagtctgtgctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgagggcagtaagcggccctcaggggcttctaatcgcttctctggctccaagtctggcaacacggcctccctgacaatctctgggctccaggctgaggacgaggctgattattactgcagctcatatacaaccaggagcactcgagttttcggcggagggaccaagctgaccgtcctaggt

SEQ ID NO: 176 - DNA, 747 bp, Artificial Sequence
  CDS (1)..(747): Polynucleotide encoding NGE2433 scFv protein
caggtgcagctggtgcagtctgggggagtcgtggtacagcctggggggtccctgagactctcctgtgcagcctctggattcacctttgatgattatgccatgcactgggtccgtcaagctccggggaagggtctggagtgggtctctcttattagttgggatggtggtagcacctactatgcagactctgtgaagggtcgattcaccatctccagagacaacagcaaaaactccctgtatctgcaaatgaacagtctgagagctgaggacaccgccttgtattactgtgcaaaagatctgaattacgatttttggagtggtctcggtatggacgtctggggccaaggcaccctggtcactgtctcctcaggtggaggcggttcaggcggaggtggcagcggcggtggcggatcgcagtctgtgctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcactcgagttttcggcggagggaccaagctgaccgtcctaggt

SEQ ID NO: 177 - DNA, 717 bp, Artificial Sequence
  CDS (1)..(717): Polynucleotide encoding NGE2435 scFv protein
caggtgcagctgcaggagtcgggcccaggactggtgaagccttcggagaccctgtccctcacctgcgttgtctctggtggctccatcagcagtagtaactggtggagctgggtccgccagcccccaaggaaggggctggagtggattggggaaatctatcatagtgggagccccaactacaacccgtccctcaagagtcgagtcaccatatcagtagacaagtccaagaaccagttctccctgaagctgagctctgtgacccccgcggacacggccgtgtattactgtgcaagacagtgggaggggattccttcttggggcaagggaaccctggtcaccgtctcctcaggtggaggcggttcaggcggaggtggcagcggcggtggcggatcatctgagctgactcaggaccctgctgtgtctgtggccttgggacagacagtcaggatcacatgccaaggggacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcctgggacagcagtggtaaccatgtggtattcggcggagggaccaagctgaccgtcctaggt

SEQ ID NO: 178 - DNA, 765 bp, Artificial Sequence
  CDS (1)..(765): Polynucleotide encoding NGE2439 scFv protein
gaggtgcagctggtggagtccggggctgaggtgaaggagcctggggcctcagtgaaggtctcctgcaaggcttctggatacaccttcaccggctactatatgcactgggtgcgacaggcccctggacaagggcttgagtggatgggatggatcaaccctaacagtggtgacacacactatgcacagaagtttcagggcagggtcaccatgaccagggacacgtccgtcagcacagcctacatggagctgagcagcctgagatctgaggacacggccgtgtattactgtgcgagagggaggtcgcggtacgatttttggagtggttattacgggggggactacgactattactacatagacgtctgggggcaagggaccacggtcaccgtctcgagtggtggaggcggttcaggcggaggtggcagcggcggtggcggatcgtctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaagacaaccggccctcagggatcccagaccgattctctggctccagctcaggaaacacagcttccttgaccatcactggggctcaggcggaagatgaggctgactattactgtaactctcgggacagcagtggtaaccatgtggtattcggcggagggaccaagctgaccgtcctaggt

SEQ ID NO: 179 - DNA, 747 bp, Artificial Sequence
  CDS (1)..(747): Polynucleotide encoding NGE2445 scFv protein
gaggtccagctggtgcagtctggaggagtcgtggtacagcctggggggtccctgagactctcctgtgcagcctctggattcacctttgatgattatgccatgcactgggtccgtcaagctccggggaagggtctggagtgggtctctcttattagttgggatggtggtagcacctactatgcagactctgtgaagggtcgattcaccatctccagagacaacagcaaaaactccctgtatctgcaaatgaacagtctgagagctgaggacaccgccttgtattactgtgcaaaagatctgaattacgatttttggagtggtctcggtatggacgtctggggccagggcaccctggtcaccgtctcctcaggtggaggcggttcaggcggaggtggcagcggcggtggcggatcgcagtctgtgctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgagctccaggctgaggacgaggctgattattactgcagctcatatacaaccaggagcactcgagttttcggcggagggaccaagctgaccgtcctaggt

SEQ ID NO: 180 - DNA, 714 bp, Artificial Sequence
  CDS (1)..(714): Polynucleotide encoding NGE2446 scFv protein
caggtacagctgcagcagtcaggcccaggactggtgaggccttcggagaccctgtccctcacctgcgctgtttatggtgagtccttaactggttactactggagctggatccgccaggcccccggacaggggctggagtggattggagaaattaatcatagtgaaaccaccaactacaacccgtccctcaagagtcgacttaccatatcagtagacacctccaagaaccaattctccctgaagctgacctctgtgactgccgcagacacggccgtgtattattgtgccagaggggggactcttttggggtactggggccgaggaaccctggtcaccgtctcctcaggtggaggcggttcaggcggaggtggcagcggcggtggcggatcgtctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaaccatgtggtattcggcggagggaccaagctgaccgtcctaggt

SEQ ID NO: 181 - DNA, 750 bp, Artificial Sequence
  CDS (1)..(750): Polynucleotide encoding NGE2447 scFv protein
gaggtgcagctggtgcagtctgggggaggcttggtacagcctggggggtccctgagactctcctgtgcagcctctgggttcaccttcagtagctatagcatgaactgggtccgccaggctccagggaaggggccggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagcttcccctgctactttggagtggttattcccgtactactactacatggacgtctgggggcaagggaccacggtcaccgtctcgagtggtggaggcggttcaggcggaggtggcagcggcggtggcggatcggacatcgtgatgacccagtctccttccaccctgtctgcatctgtaggagacagagtcaccatcacttgccgggccagtcagggtattagtagctggttggcctggtatcagcagaaaccagggagagcccctaaggtcttgatctataaggcatctactttagaaagtggggtcccatcaaggttcagcggcagtggatctgggacagatttcactctcaccatcagcagtctgcaacctgaagattttgcaacttactactgtcaacagagttacagtaccccgtggacgttcggccaagggaccaagctggagatcaaacgt

SEQ ID NO: 182 - DNA, 735 bp, Artificial Sequence
  CDS (1)..(735): Polynucleotide encoding NGE2458 scFv protein
caggtacagctgcagcagtcaggggctgaggtgaagaagcctgggtcctcggtgacggtctcctgcaaggcttctggaggcaccttcaccagctatgctatcaactgggtgcgacaggcccctggacaagggcttgagtggatgggaaggaccatccctgaccttggtatagcagactacgcacagaagttccagggcagagtctcgattaccgcgcacaaatttacgaacacagcctacatggagctgagcagcctgaaatctgacgacacggccgtgtattactgtgcgagagcccctgtactaatggcgccgggcggcggtatggacgtctggggcaagggcaccctggtcaccgtttcgagtggtggaggcggttcaggcggaggtggcagcggcggtggcggatcgtctgagctgactcaggaccctgctgtgtctgtggccttgggacagacagtcaggatcacatgccaaggagacagcctcaaaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaaccatgtggtattcggcggagggaccaagctgaccgtcctaggt

SEQ ID NO: 183 - DNA, 750 bp, Artificial Sequence
  CDS (1)..(750): Polynucleotide encoding NGE2506 scFv protein
gaggtgcagctggtggagtctgggggaggcgtggtccagcctgggaggtccctgagactctcctgtgcagcctctggattcaccttcagaagctatggcatgcactgggtccgccaggctccaggcaaggggctggagtgggtggcaggtatatcatatgatggaagtaataaatactatgcagactccgtgaagggccgattcaccatctccagagacaattccaagaacacgctgtatctgcaaatgaacagcctgagagctgaggacacggcaatgtattactgtgcgagagatcagtcggtctacttcggtgacttagcctggtacttcgatctctggggcaggggaaccctggtcaccgtctcctcaggtggaggcggttcaggcggaggtggcagcggcggtggcggatcgcagtctgtgttgacgcagccgccctcagtgtctgcggccccaggacagaaggtcaccatttcctgctctggaagcacctccaacattgggaataattatgtctcctggtaccaacagcacccaggcaaagcccccaaactcatgatttatgatgtcagtaagcggccctcaggggtccctgaccgattctctggctccaagtctggcaactcagcctccctggacatcagtgggctccagtctgaggatgaggctgattattactgtgcagcatgggatgacagcctgagtgaatttctcttcggaactgggaccaagctgaccgtcctaggt

SEQ ID NO: 184 - DNA, 747 bp, Artificial Sequence
  CDS (1)..(747): Polynucleotide encoding NGE2527 scFv protein
caggtgcagctggtgcagtctgggggagtcttggtacagcctggggggtccctgagactctcctgtgcagcctctggattcacctttgatgattatgccatgcactgggtccgtcaagctccggggaagggtctggagtgggtctctcttattagttgggatggtggtagcacctactatgcagactctgtgaagggtcgattcaccatctccagagacaacagcaaaaactccctgtatctgcaaatgaacagtctgagagctgaggacaccgccttgtattactgtgcaacagatctgaattacgatttttggagtggttccagtatggacgtctggggcaagggaactatggtcaccgtctcctcaggtggaggcggttcaggcggaggtggcagcggcggtggcggatcgcagtctgtgctgactcagcctgcctccgtgtctgggtctcctggacagtcgatcaccatctcctgcactggagccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcactcgagttttcggcggagggaccaagctgaccgtcctaggt

SEQ ID NO: 185 - DNA, 732 bp, Artificial Sequence
  CDS (1)..(732): Polynucleotide encoding NGE2595 scFv protein
caagtgcggctggtgcagtctggggctgaggtgaagaagcctggggcctcagtgaaggtctcctgcaaggcttctggatacaccttcaccggctactatatgcactgggtgcgacaggcccctggacaagggcttgagtggatgggatggatcaaccctaacagtggtggcacaaactatgcacagaagtttcagggcagggccaccatgaccagggacacgtccatcagcacagcctacatggagctgagcaggctgagatctgacgacacggccgtgtattactgtgcgagagccaagtcccgctggtaccccaactattttgactactggggccaagggacaatggtcaccgtctcttctggtggaggcggttcaggcggaggtggcagcggcggtggcggatcggacatccagatgacccagtctccttccaccctgtctgcatctattggagtcagagtcaccatcacctgccgggccagtgagggtatttatcactggttggcctggtatcagcagaagccagggaaagcccctaaactcctgatctatgaggcctctagtttagccagtggggccccatcaaggttcagcggcagtgaatctgggacagatttcactctcaccatcagcagcctgcagcctgatgattttgcaacttattactgccaacaatatagtaattatccgctcactttcggcggagggaccaagctggagatcaaacgt

SEQ ID NO: 186 - DNA, 750 bp, Artificial Sequence
  CDS (1)..(750): Polynucleotide encoding NGE2634 scFv protein
caggtgcagctggtgcaatctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggctgtgtattactgtgcgaaaggggcctattacgatttttggagtggttatacccccccatactacatggacgtctggggccgagggacaatggtcaccgtctcgagtggtggaggcggttcaggcggaggtggcagcggcggtggcggatcggacatccagatgacccagtctccttccaccctgtctgcatctattggagacagagtcaccatcacctgccgggccagtgagggtatttatcactggttggcctggtatcagcagaagccagggaaagcccctaaactcctgatctataaggcctctagtttagccagtggggccccatcaaggttcagcggcagtggatctgggacagatttcactctcaccatcagcagcctgcagcctgatgattttgcaacttattactgccaacaatatagtaattatccgctcactttcggcggagggaccaagctggagatcaaacgt

SEQ ID NO: 187 - DNA, 726 bp, Artificial Sequence
  CDS (1)..(726): Polynucleotide encoding NGE2638 scFv protein
caggtgcagctggtgcagtctgggggaggcttggtcaaacctggagggtccctgagactctcctgtgcagcctctggattcaccttcagtagttatgaaatgaactgggtccgccaggctccagggaaggggctggagtgggtttcatacattagtagtagtggtagtaccatatactacgcagactctgtgaagggccgattcaccatctccagagacaacgccaagaactcactgtatctgcaaatgaacagcctgagagccgaggacacggctgtttattactgtgctagggcaagtggatatgatggcgtctggggccagggcaccctggtcaccgtctcgagtggtggaggcggttcaggcggaggtggcagcggcggtggcgggtcgcagtctgtgctgactcagccaccctcagcgtctgggacccccgggcagagggtcaccatctcttgttctggaagcagctccaacgtcgggagtaacactgtaaactggtaccagcgactcccaggagcggccccccaactcctcatctacaataatgaccagcggccctcagggatccctgaccgattctctggctccaagtctggcacctcaggctccctggtcatcagtgggctccagtctgaagatgaggctgattactactgtgcgtcatgggatgacagtctgaatggtcgggtgttcggcggagggaccaagctgaccgtcctaggt

SEQ ID NO: 188 - DNA, 726 bp, Artificial Sequence
  CDS (1)..(726): Polynucleotide encoding NGE2648 scFv protein
caggtacagctgcagcagtcagggagaggcttggtacagccagggcggtccctgagactctcctgtacagcttctggattcacctttggtgattatgctatgagctgggtccgccaggctccagggaaggggctggagtgggtaggtctcattagaagcaaagcttatggtgggacaacagaatacgccgcgtctgtgaaaggcagattcaccatctcaagagatgattccaaaagcatcgcctatctgcaaatgaacagcctgagaaccgaggacacagccgtgtattactgtgcgaccgatttttggagtggttactcctactggggcaaaggcaccctggtcaccgtctcgagtggtggaggcggttcaggcggaggtggcagcggcggtggcggatcggacatccagatgacccagtctccttccaccctgtctgcatctattggagacagagtcaccatcacctgccgggccagtgagggtatttatcactggttggcctggtatcagcagaagccagggaaagcccctaaactcctgatctataaggcctctagtttagccagtggggccccatcaaggttcagcggcagtggatctgggacagatttcactctcaccatcagcagcctgcagcctgatgattttgcaacttattactgccaacaatatagtaattatccgctcacttttggcggagggaccaagctggagatcaaacgt

SEQ ID NO: 189 - DNA, 732 bp, Artificial Sequence
  CDS (1)..(732): Polynucleotide encoding NGE2741 scFv protein
ggggtgcagctggtgcagtctggggctgaggtgaagaagcctggggcctcagtgaaggtctcctgcaagacttctggatacagtttcaccgactactttatccattgggtgcggcaggcccctggacaagggcttgagtggatgggttggatcaatcctcagagtggaggctcacatagtgcacagaaatttcacggcagggtcaccgtgaccagggacacgtccatcaaaactgcctacatggaggtgaccagcctaacatctgacgacacggctgtgtatttctgtgcgagagagggtcccccctggaccaattactactttgactactggggccggggaaccctggtcaccgtctcctcaggtggaggcggttcaggcggaggtggcagcggcggtggcggatcggacatcgtgatgacccagtctccttccaccctgtctgcatctgtaggagacagagtcaccatcacttgccgggccagtcagggtattagtagctggttggcctggtaccagcagaaaccagggagagcccctaaggtcttgatctataaggcatctactttagaaagtggggtcccatcaaggttcagcggcagtggatctgggacagatttcactctcaccatcagcagtctgcaacctgaagattttgcaacttactactgtcaacagagttacagtgccccgtggacgttcggccaagggaccaagctggagatcaaacgt

SEQ ID NO: 190 - DNA, 747 bp, Artificial Sequence
  CDS (1)..(747): Polynucleotide encoding NGE2775 scFv protein
caggtgcagctggtgcagtctgggggagtcgtggtacagcctggggggtccctgagactctcctgtgcagcctctggattcacctttgatgattatgccatgcactgggtccgtcaagctccggggaagggtctggagtgggtctctcttattagttgggatggtggtagcacctactatgcagactctgtgaagggtcgattcaccatctccagagacaacagcaaaaactccctgtatctgcaaatgaacagtctgagagctgaggacaccgccttgtattactgtgcaaaagatctgaattacgatttttggagtggttccggtatagacgtctggggcaagggcaccctggtcaccgtctcgagtggtggaggcggttcaggcggaggtggcagcggcggtggcggatcgcagtctgtgctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaactctgcctccctcaccatctctggactgaagactgaggacgaggctgactactactgtcagtcttatgatagcagcaatcattgggtgttcggcggagggaccaagctgaccgtcttaggt

SEQ ID NO: 191 - DNA, 753 bp, Artificial Sequence
  CDS (1)..(753): Polynucleotide encoding NGE2868 scFv protein
gaggtgcagctggtgcagtctgggggagtcgtggtacagcctggggggtccctgagactctcctgtgcagcctctggattcatctttgatgattatgccatgcactgggtccggcgagctccggggaagggtctggagtgggtctcacttattagttgggatggtggtagtacctactatgcagactctgtgaagggtcgattcaccatctccagagacaacagcaaaaactccctgtatctgcaaatgaacagtctgagagctgaggacaccgccttgtattactgtgcaaaagatgttgaaggttacgatttttggagtacttactacggtatggacgcctggggccagggaaccacggtcaccgtctcttcaggtggaggcggttcaggcggaggtggcagcggcggtggcggatcgcagtctgtgctgactcagcctgcctccgtgtctgggtctcctggacagtcgatcaccatctcctgcactggaaccagcagtgacgttggtggttataactatgtctcctggtaccaacaacgcccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcactcgagttttcggcggaggggccaagctgaccgtcctaggt

SEQ ID NO: 192 - DNA, 726 bp, Artificial Sequence
  CDS (1)..(726): Polynucleotide encoding NGE2889 scFv protein
gaagtgcagctggtggagtctggggcagaggtgaagaagcctggggcctcagtgaaggtttcctgcaaggcatctggatacaccttcaccagctactatatgcactgggtgcgacaggcccctggacaagggcttgagtggatgggatggatgaaccctaacagtggtaacacaggttatgcacagaagttccagggcagagtcaccatgaccaggaacacctccataagcacagcctacatggagctgagcagcctgagatctgaggacacggccgtgtattactgtgcgagaggtggggcccgatactactacatggacgtctggggcaaaggcaccctggtcaccgtctcctcaggtggaggcggttcaggcggaggtggcagcggcggtggcggatcggacatcgtgatgacccagtctccttccaccctgtctgcatctgtaggagacagagtcaccatcacttgccgggccagtcagggtattagtagctggttggcctggtatcagcagaaaccagggagagcccctaaggtcttgatctataaggcatctactttagaaagtggggtcccatcaaggttcagcggcagtggatctgggacagatttcactctcaccatcagcagtctgcaacctgaagattttgcaacttactactgtcaacagagtcacagtaccccgtggacgttcggccaagggaccaagctggagatcaaacgt

SEQ ID NO: 193 - DNA, 765 bp, Artificial Sequence
  CDS (1)..(765): Polynucleotide encoding NGE2927 scFv protein
caggtccagctggtacagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtaataaatactatgcagactccgtgaagggccgattcaccatctccagagacaattccaagaacacgctgtatctgcaaatgaacagcctgagagctgaggacacggccgtgtattactgtgcgagaggcccgcatcccccaagatattgtagtggtggtagctgctcgtacggtatggacgtctggggcagagggacaatggtcaccgtctcttcaggtggaggcggttcaggcggaggtggcagcggcggtggcggatcgtcctatgtgctgactcagcccccctcagtgtctgggacccccgggcagagagtcaccatctcttgttctggaggcagatccaacatcggcagtaatactgtaaagtggtatcagcagctcccaggaacggcccccaaactcctcatctatggcaatgatcagcggccctcaggggtccctgaccgattctctggctccaagtctggcacctcagcctccctggccatcactggggtccaggctgaagacgaggctgactattactgccagtcatatgacagcagcctgaggggttcgagggtcttcggaactgggaccaaggtcaccgtcctaggt

SEQ ID NO: 194 - DNA, 759 bp, Artificial Sequence
  CDS (1)..(759): Polynucleotide encoding NGE2938 scFv protein
caggtgcagctacagcagtggggcccaggactggtgaagccttcacagaccctgtccctcacctgcactgtctctggtggctccatcagcagtagagatcacttctggagctgggtccgccagaccccagggaagggactggagtggattgggtatatgtattacaatggaatcaccaactacaacccctccctcaagagtcgagtcaccatatcagtagacacgtccaagaaccaggtctccctgcagctgaactctgtgaccgctgcggacacggccgtgtattactgtgcgagggcacccgcaatctcgagcagcagctggcccgacccggccagtattgactactggggccagggcaccctggtcaccgtctcgagtggtggaggcggttcaggcggaggtggcagcggcggtggcggatcgcagactgtgctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcactcgagttttcggcggagggaccaagctgaccgtcctaggt

SEQ ID NO: 195 - DNA, 714 bp, Artificial Sequence
  CDS (1)..(714): Polynucleotide encoding NGE2967 scFv protein
caggtgcagctacagcagtggggcgcaggactgttgaagccttcggagaccctgtccctcacctgcgctgtctatggtgggtccttcagtggttactactggagttggatccgccagcccccagggaaggggctggagtggattggggaagtcgatcacagtggcgacaccacctacaggccgtccctcaggagtcgtgtcaccatatcagtagacacgtccaagaaccagttctccctgaagctgagctctgtgaccgctgcggacacggccgtgtattactgtgcgagaggcgggagctaccaagactactggggccaagggacagtggtcaccgtctcgagtggtggaggcggttcaggcggaggtggcagcggcggtggcggatcgtctgagctgactcaggaccctgctgtgtctgtggcctcgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaaccatgtggtattcggcggagggaccaagctgaccgtcctaggt

SEQ ID NO: 196 - DNA, 747 bp, Artificial Sequence
  CDS (1)..(747): Polynucleotide encoding NGE2968 scFv protein
caggtgcagctggtgcagtctgggggaggcgtggtccagcctgggaggtccctgagactctcctgtgcagcctctggattcaccttcagtagctatggcatgcactgggtccgccaggctccaggcaaggggctggagtgggtggcagttatatcatatgatggaagtattaaatactatgcagactccgtgaagggccgattcaccatctccagagacaattccaagaacacgctgtatctgcaaatgaacagcctgagagctgaggacacggctgtgtattactgtgcgcgaactggtgaatatagtggctacgatacgagtggtttccagcactggggccggggaaccctggtcaccgtctcctcaggtggaggcggttcaggcggaggtggtagcggcggtggcggatcgcagtctgtgctgactcagccaccctcagcgtctgggacccccgggcagagggtcaccatctcttgttctggaagcagctccaacatcgggagtaacactgtaaactggtaccagcgactcccaggagcggccccccaactcctcatctacaataatgaccagcggccctcagggatccctgaccgattctctggctccaagtctggcacctcaggctccctggtcatcagtgggctccagtctgaagatgaggctgattactactgtgcgtcatgggatgacagtctgaatggtcgggtgttcggcggagggaccaagctgaccgtcctaggt

SEQ ID NO: 197 - DNA, 750 bp, Artificial Sequence
  CDS (1)..(750): Polynucleotide encoding NGE2988 scFv protein
caggtacagctgcagcagtcaggcccaggactggtgaagccttcggagaccctgtccctcacctgcactgtctctggtggctccgtcagcagtggtagttacttctggagctggatccggcagcccccagggaagggactggagtggattgggaatatctattacagtgggagcaccaactacaacccctccctcaagagtcgagtcaccatatcagtagacacgtccaggaaccagttctccctgaagttaagctctgtgaccgctgcggacacggccgtgtattactgtgcgagaggggtctattacgatttttgggggaaccacggtatggacgtctggggcaaagggtcaatggtcaccgtctcctcaggtggaggcggttcaggcggaggtggcagcggcggtggcggatcgcagtctgtgctgactcagcctgcctccgtgtctgggtcccctggacagtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcactcgagttttcggcggagggaccaagctgaccgtcctaggt

SEQ ID NO: 198 - DNA, 732 bp, Artificial Sequence
  CDS (1)..(732): Polynucleotide encoding NGE3006 scFv protein
gaggtgcagctggtgcagtctgggggtgaggtgaagaggcctggggcctcagtgaaggtctcctgcaaggcctctggtagcacctttgccagttatggtatcagctgggtgcgacaggcccctggacaaggccttgagtggatgggctggatcagcgattccaatactaacacaaaatatgcacagaggttccacggcagagtctccttgaccacagacacatccacgaacacagccttcatggagctgcggagcctgacatctgacgacacggccatatattactgtgccgtgatgtccgaatatgactactaccactactacatggacgtctggggccgagggaccacggtcaccgtcccctcaggtggaggcggttcaggcggaggtggcagcggcggtggcggatcgtctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaaccgggtattcggcggagggaccaagctgaccgtcctaggt

SEQ ID NO: 199 - DNA, 750 bp, Artificial Sequence
  CDS (1)..(750): Polynucleotide encoding NGE3027 scFv protein
gaggtgcagctggtggagactgggggaggcttggtaaagcctggggggtcccttagactctcctgtgcagcctctggattcactttcagtaacgcctggatgagctgggtccgccaggctccagggaaggggctggagtgggttggccgtattaaaagcaaaactgatggtgggacaacagactacgctgcacccgtgaaaggcagattcaccatctcaagagatgattcaaaaaacacgctgtatctgcaaatgaacagcctgaaaaccgaggacacagccgtgtattactgtaccacagaggcaagtggctggtacgggttcgcggcggagtactactttgactactggggccagggcaccctggtcaccgtctcctcaggtggaggcggttcaggcggaggtggcagcggcggtggcggatcgtctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggccccagctcaggaaacacagcttccttgaccatcactggggctcaggcggaagatgaggctgactattactgtgactcccgggacagcagtggtaaccatgtggtattcggcggagggaccaagctgaccgtcctaggt

SEQ ID NO: 200 - DNA, 723 bp, Artificial Sequence
  CDS (1)..(723): Polynucleotide encoding NGE3040 scFv protein
gaggtgcagctggtgcagtctggggctgaggtgaagaagactgggtcctcagtgaaggttttctgcaaggcttccggatacaccttcacctaccgctacctgcactgggtgcgacaggcccccggacaagcgcttgagtggatgggatggatcacacctttcaatggtaacaccaactacgcacagaaattccaggacagagtcaccattaccagggacaggtctatgaccactgcctccatggagctgagcagcctgagatctgaggacacagccatgtattactgtgtcacgggatctgacgaatatgcttttgagatgtggggccagggaaccctggtcaccgtctcttcaggtggaggcggttcaggcggaggtggcagcggcggtggcggatcggacatcgtgatgacccagtctccttccaccctgtctgcatctgtaggagacagagtcaccatcacttgccgggccagtcagggtattagtagctggttggcctggtatcagcagaaaccagggagagcccctaaggtcttgatctataaggcatctactttagaaagtggggtcccatcaaggttcagcggcagtggatctgggacagatttcactctcaccatcagcagtctgcaacctgaagattttgcaacttactactgtcaacagagttacagtaccccgtggacgttcggccaagggaccaagctagagatcaaacgt

SEQ ID NO: 201 - DNA, 747 bp, Artificial Sequence
  CDS (1)..(747): Polynucleotide encoding NGE3102 scFv protein
caagtgcagctggtggagtctgggggaggcttggtacagcctggggggtccctgagactctcctgtgcaacctctggattcacctttgatgattatgccatgcactgggtccgtcaagctccggggaagggtctggagtgggtctctcttattagttgggatggtggtagcacctactatgcagactctgtgaagagtcgattcaccatctccagagacagcagcaacaacttcctgtatctgcaaatgaacagtctgagagctgaggacaccgccttgtattgctgtgcaaaagatctgaattacgatttttggagtggtaccggtatggtcgtctggggcaaaggcaccttggtcaccgtctcctcaggtggaggcggttcaggcggaggtggcagcggcggtggcggatcgcagtctgtgctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgagggcagtaagcggccctcaggggtttctaatcgcttctctggctccaagtctggcaacacggcctccctgacaatctctgggctccaggctgaggacgaggctgattattactgcagctcatatacaaccaggagcactcgagttttcggcggagggaccaagctgaccgtcctaggt

SEQ ID NO: 202 - DNA, 714 bp, Artificial Sequence
  CDS (1)..(714): Polynucleotide encoding NGE3181 scFv protein
caggtgcagctacagcagtggggcgcaggactgttgaagccttcggagaccctgtccctcacctgcgctgtctatggtgggtccttcagtggttactactggagctggatccgccagcccccagggaaggggctggagtggattggggaaatcaatcatagtggaagcaccaactacaacccgtccctcaagagtcgagtcaccatatcagcagacacgtccaagaaccagttctccctgaagctgagctctgtgaccgccgcggacacggctgtgtattactgtgcgagaggcagtttattacttgactattggggccgaggcaccctggtcaccgtctcgagtggtggaggcggttcaggcggaggtggcagcggcggtggcggatcgtctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggacagcagtggtaaccatgtggtattcggcggagggaccaagctgaccgtcctaggt

SEQ ID NO: 203 - DNA, 774 bp, Artificial Sequence
  CDS (1)..(774): Polynucleotide encoding NGF0502 scFv protein
cagctgcagctgcaggagtcgggcccaggactggtgaagccttcacagaccctgtccctcacctgcactgtctctggtggctccatcagtagtggtgattactactggagttggatccgccagcccccagggaagggcctggagtggattgggtacatctattacagtgggagcacctactacaatccgtccctcaggagtcgacttaccatctcagtagacacgtccaagaaccagttctccctgaatttaaactctgtgacggccgcagacacggccgtgtattactgtgccagagacccccccccgaatatagcagccctgtccagtgggtactactacatggacgtctggggccggggaaccctggtcaccgtctcgagtggaggcggcggttcaggcggaggtggctctggcggtggcggaagtgcacttgacatccagttgacccagtctccagacttcctggctgtgtctctgggcgagagggccaccctcaagtgcaaggccagccagactgttttatccagttccaacaaaaagaacttcttagcctggtaccagcagaagccgggacaggctcctagactcctctttttctgggcatccatgcgtgaattcggggtccctgaccgattcgctggcagcgggtctgggacagatttcactctcaccatcagcagcctgcagactgaagatgtgggaatttatttctgtcagcaatattattctactcccactttcggcggagggacacgactggagattaaacgt

SEQ ID NO: 204 - DNA, 747 bp, Artificial Sequence
  CDS (1)..(747): Polynucleotide encoding NGF0503 scFv protein
caggtgcagctggtgcaatctggggctgaggtgaagaagcctgggtcttcagtgaaggtctcctgcaagggctctggagacaccttcagcatctctggttttagctgggtgcgacaggcccctggacaagggcttgagtggatgggaggcatcagccctctcttgggtacaccaaagtacgcacagaagttccagggcagagtcaccattaccgcggacgaatcgacgagcgcagtctacatggagatgagcagcctgagatctgaggacacggccgtttatttctgtgcgaagacgtcgtttgtagtagcaccagacggtactggttaccttgactactggggccggggcaccctggtcaccgtctcgagtggaggcggcggttcaggcggaggtggctctggcggtggcggaagtgcacttgacatccagttgacccagtctccttccaccctgtctgcatctgtaggagacagagtcaccatcgcttgccgggccagtcagagtgtgagtaggtcattggcctggtatcagcagaaaccagggaaagcccctaagctcctgatctatgatgcctccaggttggaaagtggggtcccatcaaggttcagcggcagtggatttgggacagaattcactctcaccatcaccagcctgcagcctgatgattttgcaacttattactgtcaacagtataaaggttattctgggacgttcggccaagggacacgactggagattaaacgt

SEQ ID NO: 205 - DNA, 744 bp, Artificial Sequence
  CDS (1)..(744): Polynucleotide encoding NGF0532 scFv protein
gaggtccagctggtgcagtctggagctgaggtgaagaggcctggggcctcagtgaaggtctcctgtaagacttctggttacacctttaccaactttggtctcagctgggtgcgacaggcccctggacaagggcttgagtggctgggatggatcagcggttccaatactgacacaaagtatgcacagagggtccagggcagactcaccatgaccacagacacatccacgagcacagcctacatggagttgaggagcctaacatctgacgacacggccgtgtattactgtgcgagagatcactcccagccaatgctctattcacctgactactggggccggggcaccctggtcaccgtctcgagtggaggcggcggttcaggcggaggtggctctggcggtggcggaagtgcacagactgtggtgatccaggagccatcgttctcagtgtcccctggagggacagtcactctcacttgtggcttgagctctggcgccgtctcttccactcaccaccccagttggtaccagcacaccccaggccagcctccacgcaccctcatctacagcacacacattcgctcttctggggtccctgatcgcttctctgcctccattcttgggaacaaagctgccctcaccatcacgggggcccaggcggacgatgaatctaattatttctgtgtactctacatgggctttggcacttgggtgttcggcggagggaccaaggtcaccgtcctaggt

SEQ ID NO: 206 - DNA, 762 bp, Artificial Sequence
  CDS (1)..(762): Polynucleotide encoding NGF0577 scFv protein
caggtacagctgcagcagtcaggggctgaggtgaagaagcctggggcctcagtgaaggtttcctgcaaggcttctggatacaccttcagtgcctatgctatacattgggtgcgccaggcccccggacaaaggcttgagtgggtgggcagggccagcgggggcaattataaccgaaaatattcacagaagttgcaggacagagtcaccttcaccagcgacacatccgcgaccacagcctacatggagctgagcagcctgacctctgaagacacggctgtttattactgtgtgcgagaggatcatgattacgatctttggagtgattacaaaggtttggacgtctggggcagaggaaccctggtcaccgtctcgagtggaggcggcggttcaggcggaggtggctctggcggtggcggaagtgcacagtctgccctgactcagcctgcctccgtgtctgggtctcctggacagtcgatcaccatctcctgcactggaattagcggtggtattggggctcataatcttgtctcctggtaccaacaacacccaggcgaggcccccacactcatgatttttgaggacactaagcggccctcaggggtttctaatcgcttctctggctccaagtctggcaacacggcctccctgacaatctctgcgctccagactgaggacgaggctgattattactgcttctcatatccacgtagtggtggtggcatgttgggattcggcggagggaccaaggtcaccgtcctaggt

SEQ ID NO: 207 - DNA, 777 bp, Artificial Sequence
  CDS (1)..(777): Polynucleotide encoding NGF0746 scFv protein
gaggtgcagctggtggagaccggggggaggcgtggtccagcctgggaggtcactgagactctcctgtgcagcgtctggtttcaccttgcggcagatatggcatacactgggtccgccaggctccaggcaagggggctggagtgggtggcccttattttttatgatggatctcacagatactatgccgactccgtgaagggccgattcaccatctccagagacaattccaagaacacgctgtctctgcaaatgaacagcctcagagtcgaggactcggctgtgtattactgtgtgagggcgagatctcgctttggttcgggaagttataaaaacattgaccttgaattgttctacttagacaactggggccggggcaccctggtcaccgtctcgagtggaggcggcggttcaggcggaggtggctctggcggtggcggaagtgcacttgaaattgtgctgactcagtctccaggcaccctgtctttgtctccaggggaaagagccaccctctcctgcagggccagtcagagcgttgacagcacctacttagcctggtaccaacaaagacctggccaggctcccagagtcctcatctatggtggatccagcagggccactggcatcccagacaggttcagtggcagtgggtctgggacagacttcattctcaccatcagcagactgcaacctgaaggttttgcagtgtattactgtgagcactatggtagtccacctcgaatcaccttcggccaagggacacgactggagattaaacgt

SEQ ID NO: 208 - DNA, 759 bp, Artificial Sequence
  CDS (1)..(759): Polynucleotide encoding NGF0770 scFv protein
caggtgcagctgcaggagtcggggggaggcttagttcagccgggggggtccctgagactctcctgtggagcctctggattcaccttcagaagttactggatgcactgggtccgccaagttccagggaaggggctggcgtgggtctcacgaattaatagtgatggcagtagcacatggtacgcggactccgtgaagggccgactcaccacctccagagacaacgccaaaaacacgctgtatctgcaaatgaacagtctgagaatcgaggacacggctgtctattactgtgcaagaggcgacccggaggaactacggtctgactcctacttctactacgggatggacgtctggggccgaggcaccctggtcaccgtctcgagtggaggcggcggttcaggcggaggtggctctggcggtggcggaagtgcacaggctgtggtgatccaggagccctcactgactgtgtccccaggagggacagtcaccctcacctgttcttccagcaccggagcagtcgccagtggtcactctccaacctggttccagcagaaatatggacaagaacccaggacgctgatttatagttcaatcatcaaacactcttggacgcctgcccgattctcagggtccctccttgggggcaaggctgccctgacactgtcaggtgtgcagcctgaagacgaggctgactattactgcctcctctactttggtgatggctgggtgtgcggcggagggacccagctcaccgttttaagt

SEQ ID NO: 209 - DNA, 744 bp, Artificial Sequence
  CDS (1)..(744): Polynucleotide encoding NGF0788 scFv protein
caggtgcagctggtgcagtctgggggaggcctggtcaagccgggggggtccctgagactctcctgtgcagcctctggattcaccttcagtagatatagcatgaactgggtccgccaggctccagggaagggactggaacatgtttcagctattattgccaatggggatagcacatattacacaaactctgtgaagggcagattcaccatctccagagacaactccaaaaacaggctgtatcttcaaatgggcagtctgagacctgaggacacggcggtttattactgtgtgagagatggccctgggggtcaatggggggcttttgatatctggggcaaaggaaccctggtcaccgtctcgagtggaggcggcggttcaggcggaggtggctctggcggtggcggaagtgcacaggctgtggtgatccaggagccgtcgttgtcagtgtcccctggagggacaatctccctcacttgtggcttggcctccggctcagtctcttctaaccaccaccccagttggtaccagcagaccccaggccacactccgcgcactctcatttatagcgcaactactcgctccactggggtccctgatcgcttctctggctccatccttgggaacaaagctgccctcaccatcacgggggcccagacagaggatgaatctgattattactgtatgttatatttgggtcctggcatttgggtcttcgggggagggaccaaggtcaccgtcctaggt

SEQ ID NO: 210 - DNA, 744 bp, Artificial Sequence
  CDS (1)..(744): Polynucleotide encoding NGF0808 scFv protein
caggtgcagctgcaggagtcggggggaggcgtggtccagcctgggaagtccctgagactctcctgtgcagcctctggattcgccttcagtcgctcttccatgcactgggtccgccaggctcctggcaaggggctggaatgggtgtcagttatatcatatgatggaagcattaaatactacgcagactccgtgaagggccgattcaccatctccagagacaattccaagaacaccatgtatctgcaaatgaacagcctgagacctgaggacacggctgtgttttactgtgcgaggccgcttcaggggataccggcagctggtcttgactactggggccgggggacaatggtcaccgtctcgagtggaggcggcggttcaggcggaggtggctctggcggtggcggaagtgcacagtctgtgctgacgcagccgccctcagtgtctgcggccccaggacagaaggtcaccatctcctgctctggaatcagctccaacattgggaataatcatgtatcctggtaccaacagttcccaggaacagcccccaaactcctcatttatgacagtaataagcgaccctcagggattcctgaccgattctctggctccaagtctggcacgtcagccaccctggacatcaccggactccagactggggacgaggccgattattactgcggaacatgggataacagcctgagtgctggggtgttcggcggagggaccaagctgaccgtcctaggt

SEQ ID NO: 211 - DNA, 780 bp, Artificial Sequence
  CDS (1)..(780): Polynucleotide encoding NGF0825 scFv protein
caggtgcagctgcaggagtcgggcccaggactggtgaagccttcggagaccctgtccctcacctgcactgtctctcctgtctccgtcagtagtggtggttactactggagctggatccggcagcccccagggaagggactggagtggattggctatgtctttattaatgggaccaccaactacagcccctccctcaagagtcgagtcgccatatcattagacatgtccaagaaccagttctccctgaggctgaggtctgtgactgctgcgggcacggccgtctattactgtgcgcgagataatcgcgattattatccttcggggagtttcggatctggacttagtggctacttctactactacatggacgtctggggccgaggaaccctggtcaccgtctcgagtggaggcggcggttcaggcggaggtggctctggcggtggcggaagtgcacttgaaattgtgttgacgcagtctccaggcaccctgtctttgtctccaggggaaagagccaccgtctcctgcagggccagtcagagtgttaacagcaactacttagcctggtaccaacagattcctggccaggctcccaggctcctcatctatggtgcttccagcagggccactggcatcccagacaggttcagtggcagtgggtccgggacagacttcactctcaccatcagcagactggagcctgaagattttgcagtgtattactgtcagcagtatggtagctcacccaccttcggccaagggacacgactggagattaaacgt

SEQ ID NO: 212 - DNA, 732 bp, Artificial Sequence
  CDS (1)..(732): Polynucleotide encoding NGF0954 scFv protein
gaggtgcagctggtggagaccgggggaggcttggtccagccgggggggtccctgagactctcctgtgcagcctctggattcaccgtcagtaccgactacatgagctgggtccgccaggctccagggaaggggctggagtgggtctcagttatttatcccggtgggatcacatgctacgcagactccgtgaagggcagattcagtatctccagagaaagttccaagaacacggtgtatcttcaaatgaacagcctgagagccgaggacacggctatttattattgtgcgagagaagtcgccgactactacggtatggacgtctggggccaaggaaccctggtcaccgtctcgagtggaggcggcggttcaggcggaggtggctctggcggtggcggaagtgcacttgaaattgtgctgactcagtctccagccaccctgtctttgtctccaggggagagagccaccctctcctgcagggccagtcagaatgttaacatctacttagcctggtaccaacagaagcctggccagcctcccagggtcctcatctatgatgcatccaagagggccactggcatcccagccaggttcagtggcagtgggtctgggacagacttcacgctcaccatcagcagccttgagcctgaagattttgcagtttactactgtcaacaacgtttcgactggcctcccatcaccctcggccaagggacacgactggagattaaacgt

SEQ ID NO: 213 - DNA, 777 bp, Artificial Sequence
  CDS (1)..(777): Polynucleotide encoding NGF1A05 scFv protein
gaagtgcagctggtgcagtctgggggaggcttggtccagccgggggggtccctgagactctcctgtgcagcctctggtttcggcttcagtagttattggatgaactgggtccgcctggctcctgggaaggggctggagtgggtggccagcataaagcaagatggaagtgagatgttctatgtggactctgtgaagggccggttcaccatctccagagacaacgccaagaactcactgtctctacagatgaacagcctgagagccgaggacacggctgtgtattactgtgcgagagatcttgtccgtataacgcttgttggcgtgataacaaaatcgtacggtatggacgtctggggccgggggacaatggtcaccgtctcgagtggaggcggcggttcaggcggaggtggctctggcggtggcggaagtgcacttgatgttgtgatgactcagtctccagactccctggctgtgtctctgggcgagagggccaccatcaactgcaagtccagccagagtgttttatacagctccaacaatcagaactatctcgcttggtatcagcagagaccaggacagcctcccaaaatgctcatttatggggcatctacccgggcatccggggcccctgaccgatacagtggcggcgggtctgggacagatttcactctcaccatcagcagcctgcagcctgaagatgtggcagtttattactgtcagcagtattatagtcttccgatcaccttcggccaagggacacgactggagattaaacgt

SEQ ID NO: 214 - DNA, 762 bp, Artificial Sequence
  CDS (1)..(762): Polynucleotide encoding NGF1B02 scFv protein
gaggtgcagctggtgcagtctggggctgaggtgaagaagcctgggtcctcggtgaaagtctcctgcaaggcttctggagacacctccagtgaatattctatcacgtgggtgcgacaggtccctggacaagggcttgagtggatgggaggaatcatccctatctttggggcaacatactacgcacagaacttccagggcagagtcacgattagcgcggacgaatccacgagcacagcctacatggagctgggcagtctgagatctggggacacggccgtttattactgtgcgactgtcattcccccgaccatagggggagtaactcacgactccgaaggtatggacgtctggggcaggggcaccctggtcaccgtctcgagtggaggcggcggttcaggcggaggtggctctggcggtggcggaagtgcacagtctgtgttgacgcagccgccctcagcgtctgggacccccgggcagagggtcaccatctcttgttctggaagcagctccaacatcggaagtaattatgtatactggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacggccacaatggttgggtgttcggcggagggaccaaggtcaccgtcctaggt

SEQ ID NO: 215 - DNA, 765 bp, Artificial Sequence
  CDS (1)..(765): Polynucleotide encoding NGF1B03 scFv protein
gaagtgcagctggtgcagtctggggcagaggtgaaaaagcccggggagtctctgaggatctcctgtaagggttctggatacagctttagcagctactggatcagttgggtgcgccaggtgcccgggaaaggcctggagtggatggggaggattgatccaagtgactcttacaccaactacagtccgtccttccaaggccacgtcaccatctcagctgacaagtccatcagcactgcctacctgcactggagcagcctgaaggcctcggacaccgccatgtattactgtgcgaccctggcaagcgccgatacaggtatggtcacagactacaaatactacgatatggacgtctggggccggggcaccctggtcaccgtctcgagtggaggcggcggttcaggcggaggtggctctggcggtggcggaagtgcacagtctgtcgtgacgcagccgccctcagtgtctgcggccccaggacagaaggtcaccatctcctgctctggaagcaactccaacattggaaaaaattatgtatcttggtaccaacagctcccaggaacagcccccaaactcctcatttctgacaacaatgcgcgaccctcaggaattcctgaccgattctctggctccaagtctggcgcgtcaggcaccctggacatcaccggactccagactggggacgaggccgcttattactgcaaaagttgggacagcagcctgcgtgctgaggtgttcggcggagggaccaagctgaccgtcctaggt

SEQ ID NO: 216 - DNA, 750 bp, Artificial Sequence
  CDS (1)..(750): Polynucleotide encoding NGF1B09 scFv protein
gaagtgcagctggtgcagtctggggctgaggtgaagaagtctgggtcttcggtgaaggtctcctgcaaggcttctggagacatcttcaccaactatgctatcaactgggtgcggcaggcccctggacaagggcttgagtggatgggacggatcctccctttatttggaactacaaactacgcacagagatttcaggggagaatcacgattaccgcggacgaatccacgggcacagcctacatggagctgagcagcctgaaatctgacgacacggccgtatattattgtgcgagaccactctcaggcgattactatgatactagtggttatcactggtggggcaagggcaccctggtcaccgtctcgagtggaggcggcggttcaggcggaggtggctctggcggtggcggaagtgcacagtctgtgctgacgcagccgccctcagcgtctgggacccccggacagagggtcaccatctcttgttctggacgcagtggcaacatcggaactaatgctgtaaactggtatcagcagctccccggagcggcccccaaactcatcatttatagtaatagtcaacggccctctggggtccctcaccgattctctgcctccaggtctggcacttcagcctccctggccatcagtggcctccagtctgaggatgaggctgattattactgttctgcgtgggatgacagcctagatggtgtggtcttcggcggagggaccaaggtcaccgtcctaggt

SEQ ID NO: 217 - DNA, 756 bp, Artificial Sequence
  CDS (1)..(756): Polynucleotide encoding NGF1C10 scFv protein
gaggtgcagctggtgcagtctggagcagaggtgaaaaagcccggggagtctctgaagatctcctgtaagggttctgggtacaacattaccaaccactggatcgcctgggtgcgccagatgcccgggaaaggcctggagtggatggggatgatctatcctgatgactctgataccagatacagcccgtccttccaaggccaagtcaccatgtcagccgacaagtctatcaataccgcccatctgcagtggcgcagcctgaaggcctcggacaccgccatgtattactgtgcgagacatgctcactatgatggtagtggttattactactttgactactggggcaaggggacaatggtcaccgtctcgagtggaggcggcggttcaggcggaggtggctctggcggtggcggaagtgcacagtctgtgctgacgcagccgccctcagtgtctggggccccagggcagagggtcaccatctcctgcactgggagcagatccaacatcggggcaggttatgatgtacactggtaccagcagcttccaggaacagcccccaaagtcctcatctttggtaacagcaatcggccctcaggggtccttgaccgattctctggctccaagtctggcacctcagcctccctggccatcactgggctccaggctgaggatgaggctgattattactgccggtcctatgacagcagcatgagtggttcgagagtcttcggaactgggaccaaggtcaccgtcctaggt

SEQ ID NO: 218 - DNA, 747 bp, Artificial Sequence
  CDS (1)..(747): Polynucleotide encoding NGF1D09 scFv protein
cagctgcagctgcaggagtcgggctcaggactggtgaagccttcacagaccctgtccctcacctgcgctgtctctggtggctccatcagcagtggtgattactcctggagctggatccggcagccaccagggaagggcctggagtggattgggtacatctatcatagtgggagcacctactacaacccgtccctcaagagtcgagtcaccatatcaatagacaggtccaagaaccagttctccctgaagctgagctctgtgaccgccgcggacacggccgtgtattactgtgccagagtcggtgactacaaagaaattgatgcttttgatatctggggcaaaggaaccctggtcaccgtctcgagtggaggcggcggttcaggcggaggtggctctggcggtggcggaagtgcacagcctgtgctgactcagccaccctcagcgtctgggacccccgggcagagggtcaccatctcttgttctggaagcagctccaacatcggaactaatactgtaaactggtaccagcagctcccaggaacggcccccaaactcctcatctatagtaatactcagcggccctcaggggtccctgaccgattctctggctcgaagtctggcacctcagcctccctggccatcagtgggctccagtctgaggatgaggctgattactattgtggagcatgggatgacagcctgatttccggggtgttcggcggagggaccaagctgaccgtcctaggt

SEQ ID NO: 219 - DNA, 741 bp, Artificial Sequence
  CDS (1)..(741): Polynucleotide encoding NGF1E09 scFv protein
gaggtgcagctggtggagaccggggctgaggtgaggaagcctgggtcctcggtgaaggtctcctgcaaggcctctggaggcatcttcaaaaaatatgctttcagctgggtacgacaggcccctggccaagggcttgagtggctggggaggaccatcccttccattggtaacaacaactacatacagagtttgaagggcagagtcacccttaccgcggacgagtccacgaacacagtctacatggacctgaggaacctgagatctgaagacacggccatatatttttgtgcgggagccccgaagcggttcggggagtcccctaatttgtggggccggggcaccctggtcaccgtctcgagtggaggcggcggttcaggcggaggtggctctggcggtggcggaagtgcacaggctgtggtgatccaggagccatcgttgtcagtgtcccctggagggacagtcacactcacttgtggcttgagctccggctcagtctctaccactaactaccccacctggtaccagcagaccccaggccagtctccacgcacggtcatctacgatacatatactcgctcttctggggtccctgatcgcttctctggctccatccttggcaacaaggctgccctcactatcacgggggcccaggcagatgatgagtctgactactactgtgcattctatttgggtgaaggcatttcggttttcggcggggggaccaagctgaccgtcctaggt

SEQ ID NO: 220 - DNA, 750 bp, Artificial Sequence
  CDS (1)..(750): Polynucleotide encoding NGF1G03 scFv protein
caggtgcagctgcaggagtcgggcccaggactggtgaagccttcggagaccctgtccctcacttgcactgtctctggtgactccatcggcagtagtatttactactgggcctggatccgccagcccccagggaaggggctggagtggattgggagaatctattatagtgggaccaccaactacaacccgtccctcaagagtcgagtcaccatgtccgtagacacgtccaagaaccagttctccctgaagctgagttctgtgaccgccgcagacacggctgtgtattactgtgcgagatcgaaagggacaaagtgggagcgtcgggagtttgactactggggccgagggacaatggtcaccgtctcgagtggaggcggcggttcaggcggaggtggctctggcggtggcggaagtgcacaggctgtgctgactcagccgtcctcagcgtctgggacccccgggcagacggtgaccatctcttgttctggaagcagctccaacatcggaagcaatcctgcccactggtatcagcaattcccaggaacggccccgacactcatcatctattatgatggtcggcggccctcaggggtccctgaccgattctctggctccaagtctggcacctcagcctccctggccatcagtgggctccagtctgaggatgaggctgacttttactgtgcatcttgggatgacaacctgaatgaatatgtctttggaactgggaccaaggtcaccgtcctaggt

SEQ ID NO: 221 - DNA, 768 bp, Artificial Sequence
  CDS (1)..(768): Polynucleotide encoding NGF1H02 scFv protein
caggtccagctggtgcagtctgggggaggcttgttacagccagggcggtccctgagactctcctgtgcaggttctggattcagctttcgtgatcatgctttgagctggttccgccaggctccagggaaggggctggagtgggtaggtttcattagaagcaaaggttatggtgggacaacagaatacgccgcgtctatggcgggcagactcaacatctcaagagatgactccaaaagcatcgcctatctgcaagtgaacagcctgaaaaccgaggacacagccgtctactattgtagtagagattcggattactatgctagtagtggtatgggttacgcttttgatatgtggggcaaagggacaatggtcaccgtctcgagtggaggcggcggttcaggcggaggtggctctggcggtggcggaagtgcacaggctgtgctgactcagccgtcctcagtgtctggggccccagggcagagggtcaccatcccctgcactgggagcagctccaacatcggggctggttatggtgtacactggtaccaacaactcccagggacagcccccaaactcctcatctatgatagcgacaagcggccctcaggggtccctgaccgattctctggctccaagtctggcagctcaggctccctggccatcactgggctccagcctgaggatgaggctgattattactgccagtcctatgacagcagcctgagtgggtcgaatgtcttcggaactgggaccaaggtcaccgtcctaggt

SEQ ID NO: 222 - DNA, 723 bp, Artificial Sequence
  CDS (1)..(723): Polynucleotide encoding NGF1H06 scFv protein
caggtacagctgcagcagtcaggcccaggactggtgaagccttcggagaccctgtctctcacctgcactgtctctggtgactccatcactagttactactggagctgggtccgacagcccccggggaagacactggagtggattggatacatctttgacactaggaccaccaagtacaacccctccctcaagagtcgagtcaccatttcagccgacacgtccaagaatcaattctccctgaaattgtcctctgttactgctgcggacacggccgtatattactgtgcgagagatgctggtactatttttgactactggggccaggggacaatggtcaccgtctcgagtggaggcggcggttcaggcggaggtggctctggcggtggcggaagtgcacagtctgtgttgacgcagccgccctcagtgtcagtggccgcaggacagacggccaggattacctgtggggaagccaacattggaaggagaagtgtccactggtaccagcggaggccaggccaggcccctctaatggtcatttattatgacaccgcccggcgctcagggatccctgaacgattctctggctccaactctggggacacggccaccctgaccatcagcagggtcgaggccggcgatgaggccgactattactgtcaggcgtgggattttagtagtgatcatccggtattcggcggagggaccaaggtcaccgtcctaggt

SEQ ID NO: 223 - DNA, 768 bp, Artificial Sequence
  CDS (1)..(768): Polynucleotide encoding NGF2C06 scFv protein
gaggtgcagctggtgcagtctggggcagaggtgaaaaagcccggggagtctctgaggatctcctgtaagggttctggatacagctttagcagctactggatcagttgggtgcgccaggtgcccgggaaaggcctggagtggatggggaggattgatccaagtgactcttacaccaactacagtccgtccttccaaggccacgtcaccatctcagctgacaagtccatcagcactgcctacctgcactggagcagcctgaaagcctcggacaccgccatgtattactgtgcgaccctggcaagcgcctacacaggtatggtcacatactacaaatactacgatgtggacgtctggcgccgggcaaccctggccaccgtctcgagtggaggcggcggttcaggcggaggtggctctggcggtggcggaagtgcacaggctgtgctgactccaccctcctcagtgtttggggccccagggcagagggtcaccatctcctgcactgggagcaactccaacatcggggcaggttatgatgcacactggtaccagcagtttccaggatcagcccccaaactcctcatctatggtaacaccaatcggccctcaggggtccctgaccgattctctggctccaagtctggcacctcagcctccctggccatcactgggctccaggctgaggatgaggctgattattactgccagtcatatgacaccagcctgagtagttatgtcttcggaactgggacccagctcaccgttttaagt

SEQ ID NO: 224 - DNA, 759 bp, Artificial Sequence
  CDS (1)..(759): Polynucleotide encoding NGF2D02 scFv protein
gaggtccagctggtgcagtctggggctgaggtgaagaagcctgggtcctcggtgaaggtctcctgcaaggcttctggaggcaccctcagtagctatgcaatcaactgggtgcgccaggcccctggacaagggcttgagtggatgggacaaatcatccctatgtttggtacaatgaactacgcacagaagttccagggcagagtcactattagcgcagacgaatccacgggcacagcctacatggagttgagtagcctgagatatgacgacacggccacgtattactgtgcgagagaagtgtctggcactaggaactactactactacggtttggacgtctggggccagggaaccctggtcaccgtctcgagtggaggcggcggttcaggcggaggtggctctggcggtggcggaagtgcacaggctgtgctgactcagccgtcctcagtgtctggggccccagggcagagggtcaccatcccctgcactgggagcagctccaacatcggggcaggttatgatgtacactggtaccagcaccttccaggaacagcccccaaactcctcatctatggtaacatcaatcggccctcaggggtccctgaccgattctctggctccaagtctggcacctcagcctccctggccatcactgggctccaggctgaggatgaggctgattattactgccagtcctatgacaacaggctgagtgtttctgtggtattcggcggagggacccagctcaccgttttaagt

SEQ ID NO: 225 - DNA, 774 bp, Artificial Sequence
  CDS (1)..(774): Polynucleotide encoding NGF2D08 scFv protein
cagctgcagctgcaggagtcgggcccaggactggtgaagccctcggagaccctgtccctcacctgcgatgtctccggttcctccatcagtagtgcatattactggggctgggtccggcactccccagggaaggggctggagtggattggcagtagttataataatgggcccgcttattacaatccgtctctcataagacgcgtcaccacatcacgagacacgtccaagaaccaagtctccctgaagatgacttctatgaccgccgcagacacggccgtatattactgtgcgagagggttgagggacagtagtggctattactttggaggctactactttgacctctggggccaaggaaccctggtcaccgtctcgagtggaggcggcggttcaggcggaggtggctctggcggtggcggaagtgcacaggctgtgctgactcagccgtcttccctctctgcatctcctggagcattagccagtctcacctgcaccttacgcagtggcatcaatgttacttcctacaggatatactggcaccagcagaagccagggagtcctccccagtatctcctgaggtacaaatcagactcagataagcagcagggctctggagtccccagccgcttctctggatccaaagatgcttcggccaatgcagggattttactcatctctgggctccagtctgaggatgaggctgactattactgtttgatttggcacaacagcgccgtggtgttcggcggagggaccaagctgaccgtcctaggt

SEQ ID NO: 226 - DNA, 774 bp, Artificial Sequence
  CDS (1)..(774): Polynucleotide encoding NGF2E08 scFv protein
caggtgcagctgcaggagtcgggcccaggactggtgaggccttcggagaccctgtccctcacttgcactgtctctggttcctccgtcactagtccttactattgggcctgggtccgccagcccccagggaaggcgctggagtggatcgctagcatctatcacagtgggtccacccactacaacccgtccctcaagagtcgagtcactgtgtcaatggacacgtccaacaaccggttctccttgaaggtgacctctgtgaccgtcacagacacggctgtctattactgtgcgagacacgccagcagttattacggatccttcgtccaatatcactactacggtctgcaggtctggggcaagggcaccctggtcaccgtctcgagtggaggcggcggttcaggcggaggtggctctggcggtggcggaagtgcacttgttgttgtgatgactcagtctccagtctccctgcccgtcacccgtggacagccggcgtccatctcctgcagatctactgaaggcctcgtatatagtgatggcaacacgtacctgaattggtttcagcagaggccgggccagcctccaaggcgcctggtttatcaggtctctaggcgggaccctggagtcccagacagattcagcggcagtgggtcaggcactgatttcacactggaaatcagcagggtggaggctgaagaccttgggatttacttctgcatgcaaggtacacactggccgtacacttttggccaggggaccaaggtggaaatcaaacgt

SEQ ID NO: 227 - DNA, 735 bp, Artificial Sequence
  CDS (1)..(735): Polynucleotide encoding NGF2E11 scFv protein
caggtgcagctggtgcagtctgggggaggcgtggtccagcctgggaggtccctgagactctcctgtgcagcgtctggattaagcttcagttcctatggcatgcactgggtccgccaggctccaggcaaggggctggagtgggtggcagttatttggtttgatggaagtaataaatattatgcagactccgtgaagggccgattcaccatttccagagacacttccaagaacacactgtatctgcagatgaacagcctgagagtcgaggacacggctgtatattattgtgcgggagaggttcgcgggagtttcggggaatttgactactggggccgggggacaatggtcaccgtctcgagtggaggcggcggttcaggcggaggtggctctggcggtggcggaagtgcacagtctgtgctgactcagccaccctcggtgtcagtggccccaggaaagacggccaggattacctgtgggggaaacaacgttgaaagtaaaagtgtgcagtggtaccagcaaaagtcaggccaggcccctgtgttggtcatctattataattcctaccggccctcaggcatccctgagcgattctctggctccaactctgggaacacggccaccctgaccatcagcagggtcgaagccggggatgcggccgactattactgtcaggtgtgggatagtactactgatcattatgtcttcggaagtgggaccaaggtcaccgtcctaggt

SEQ ID NO: 228 - DNA, 741 bp, Artificial Sequence
  CDS (1)..(741): Polynucleotide encoding NGF2F11 scFv protein
caggtgcagctggtggagtctgggggaggcttggtccagccgggggggtccctgagactttcctgtgcagcctctggattcacctttagtagctattggatgagctgggtccgccaggctccagggaaggggctggagtgggtggccaacataaaacaggatggaagtgagaaatactatgtggactctgtgaagggccgattcaccatctccagagacaacgccaagagctctctgtatctgcaaatgaacagcctgagagccgaggacacggccgtgtattattgtgcgagaccccaggaacctcctagtagtttaattgcccactggggccaggggacaatggtcaccgtctcgagtggaggcggcggttcaggcggaggtggctctggcggtggcggaagtgcacagtctgtcgtgacgcagccgccctcagtgtctgcggcctcaggacagaaggtcaccatctcctgctctggaaggacctccaacattggcaataattatgtctcctggtatcagcagatcccagggacagcccccaaactcctcctttatgacaataataagcgaccctctgggattcctgaccgattctctggctccaagtctggcacgatagccatcctgggcatcaccgggctccagactggggacgaggccgattatttctgcggagtatgggatagcagcctgagtagttacgtcttcggatctgggaccaaggtcaccgtcctaggt

SEQ ID NO: 229 - DNA, 762 bp, Artificial Sequence
  CDS (1)..(762): Polynucleotide encoding NGF2G02 scFv protein
gaggtgcagctggtggagtccgggggaggcttggtacagcctggggggtccctgagactctcccgtgcagcctctggattcaccttcacgggctattacatgaactgggtccgccaggctccagggaaggggctggagtgggtttcatccatcagtactagtagtagtaccatatactacgcagactctgcgaagggccgattcaccacttccagagacaacgccaagaattcactgtatctgcaaatgaacagcctgagagccgaggacacggctgtgtattactgtgcgagggggcgggggtcttattactttgatagtagtggtccccctggctacctcgatctctggggccaagggacaatggtcaccgtctcgagtggaggcggcggttcaggcggaggtggctctggcggtggcggaagtgcacagtctgtcgtgacgcagccgccctcagcgtctggggcccccgggcagagggtcgccatctcttgttctggaagctactccagcgtcggggttaatgctgtgaactggtatcaacatctcccaggaacggcccccaaactcctcatctatggtacttctcagcggccctcaggggtccctgaccgattctctggctccaagtctggcacctcagcctccctggccatcagtgggctccagtctgaggatgaggctgaatattactgccagtcctatgacagaagcctgagagctcatgtcttcggaactgggaccaagctgaccgtcctaggt

SEQ ID NO: 230 - DNA, 765 bp, Artificial Sequence
  CDS (1)..(765): Polynucleotide encoding NGF2G10 scFv protein
gaggtgcagctggtggagtctggagctgaggtgaagaagcctggggcctcagtgaaggtctcctgcaagacttctgggtacatcttttccacctatggtatcacctgggtgcgacaggcccctggacaagggcttgagtggatgggctggattagttctaagaatggcaacacaaactatgcacagaaatttcagggcagagtcaccatgaccacagacacatccacgagcacagcctacatggagttgagtagcctcacatctgacgacacggccgtctattactgtgcgagagattcggcttactattatgacagtagtggtattggcaactggttcgacccctggggcaaaggaaccctggtcaccgtctcgagtggaggcggcggttcaggcggaggtggctctggcggtggcggaagtgcacaggctgtgctgactcagccgtcctcagtgtctggggccccaggacagcgggtcaccatctcctgcactgggagcagctccaacatcggggcaggttatgatgttcactggtaccagaaacttccagacacaggccccaaactcctcatctttggtaacgtcattcggccctcaggggtccctgaccgattctctggctccaagtctggcacctctgcctccctggccatcactgggctccaggctgaggatgaggctgaatatttctgccagtcctatgacaccaccctcagtggttcggtggtgttcggcggcgggaccaagctgaccgtcctaggt

SEQ ID NO: 231 - DNA, 747 bp, Artificial Sequence
  CDS (1)..(747): Polynucleotide encoding NGF3B08 scFv protein
caggtgcagctgcaggagtccgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtatattactgtgcgaaagatcctgatggggacccctactggtacttcgatctctggggcaaaggcaccctggtcaccgtctcgagtggaggcggcggttcaggcggaggtggctctggcggtggcggaagtgcacaggctgtgctgactcagccgtcctcagtgtctggggccccagggcagagggtcaccatctcctgcactgggagcagctccaacatcggggcagcttatgatgtacactggtaccagcaccttccaggaacagcccccagagtcctcatctatgctaacagcaatcggccctcaggggtccctggccgattctctggctccaagtctggcacctcagcctccctggccatcactgggctccaggctgaggatgaggctgattattactgccagtcctatgacagcagcctgagtggttatgtcttcggaactgggaccaagctgaccgtcctaggt

SEQ ID NO: 232 - DNA, 747 bp, Artificial Sequence
  CDS (1)..(747): Polynucleotide encoding NGF3D11 scFv protein
gaggtgcagctggtggagtctggggctgaggtgaagaagcctgggtcctcggtgaaagtctcctgtcacgtttctggaggcaccttcggaggcaatgctttcaactgggtgcgacaggccccaggacaagggcttgagtggatgggacgggtcatccctatctatggtacatcaaactacgcacagagattccagggcagagtctccattaccgcggacgagtccacggacacagcctacatggagctgagcagcctgacatctgacgacacggccatatattactgtgcgagagatccgggaagtgggccctacttgtcctactttgactcctggggccgaggcaccctggtcaccgtctcgagtggaggcggcggttcaggcggaggtggctctggcggtggcggaagtgcacaggctgtgctgactcagccgtcctcagcgtctgggacccctgggcagagggtcaccatctcttgttctggaacctactctaacatcgcaagtaatactgttaactggtaccagcaactcccaggaacggcccccaaactcctcatctacaataatcgtcagcggccctcaggggtccctgaccgattctctggctccaagtctggcacctcagcctccctggccatcagtgggctccagtctgaggatgagactgattatttctgtgcagcatgggatgacgccctgaatggttatgtcttcggaactgggaccaaggtcaccgtcctaggt

SEQ ID NO: 233 - DNA, 750 bp, Artificial Sequence
  CDS (1)..(750): Polynucleotide encoding NGF3H03 scFv protein
gaggtgcagctggtggagaccgggggaggcgtggtccagcctgggaggtccctgaggctctcctgtgcagcgtctggattcggcttcagaaactctgccatgcactgggtccgccaggctccaggcaagggactggagtgggtggccttaatatggtctgatggaattactaaattctatgcagactccgtgaagggccgattaaccgtctccagagacaattccgagagcaccctgtatctgcaaataaacagcctgagagacgaggacacggctgtctattactgtgcgagagatggacattatagtgttggtttcggtttcgacgtctggggccaggggacaatggtcaccgtctcgagtggaggcggcggttcaggcggaggtggctctggcggtggcggaagtgcacttaattttatgctgactcagccccactctgtgtcggagtctccggggaagacggtaaccatctcctgcacccgcagcagtggcagcattgccagcaactatgtgcagtggtaccagcagcgcccgggcagtgcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcaaggggtattcggcggagggaccaagctgaccgtcctaggt

SEQ ID NO: 234 - DNA, 759 bp, Artificial Sequence
  CDS (1)..(759): Polynucleotide encoding NGG2002 scFv protein
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtgtattactgtgcgagagctccgcattacgatttatggagtaaatattattttcgcggtatggacgtctggggcagggggacaatggtcaccgtctcgagtggaggcggcggttcaggcggaggtggctctggcggtggcggaagtgcacagcctgtgctgactcagcccccctcagcgtctgggacccccgggcagagagtcaccatctcttgttctggaagcagctccaacatcggaaggaatactgtaaattggtaccagcagctcccaggaacggcccccaaactcctcctctataataatgatcagcggccctcaggggtccctgaccgattctctggctccaagtctggcacctcagcctccctggccatcagtgggctccagtctgaggatgaggctgattattactgttcagcacgcgatgacagcctgaatggttatgtcttcggaactgggaccaaggtcaccgtcctaggt

SEQ ID NO: 235 - DNA, 750 bp, Artificial Sequence
  CDS (1)..(750): Polynucleotide encoding NGG2004 scFv protein
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtgtattactgtgcgagagagggcggtatactgggagctgtcgatgtttttgatatctggggcaggggaaccctggtcaccgtctcgagtggaggcggcggttcaggcggaggtggctctggcggtggcggaagtgcacagtctgtgctgactcagccaccctcagtgtctggggccccagggcagggtgtctccatctcctgcactgggaccacctccgacatcggggcgggttatactgttcagtggtatcagcagtttccaggaacagcccccaaactcctcatctatgatgattaccgtcgcccctcaggggtccctgagcgattctctggctccaagtctggcacctcagcctccctggccatcactgggctccggactgaagatgaggctgattattactgccagtcctatgacaacagcctcaagaatgtggtcttcggcggagggaccaagctgaccgtcctaggt

SEQ ID NO: 236 - DNA, 735 bp, Artificial Sequence
  CDS (1)..(735): Polynucleotide encoding NGG2007 scFv protein
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtgtattactgtgcgaaagaggggtcactagatggctactttgactactggggcaagggcaccctggtcaccgtctcgagtggaggcggcggttcaggcggaggtggctctggcggtggcggaagtgcactttcttctgagctgactcaggaccctactgtgtctgtggccttgggacagacagtccggatctcatgccaaggagacagtctcagaagttattatgcaaactggtaccagcagaaaccaggacaggcccctctacttgtcatgtatgatacaagcaaccggccctcaggtatcccagaccgattctctggctccagctcaggaaacacagcttccctgaccatcactggggctcaggcggaagatgaggctgagtacttctgtagctcccgggacatcagtgataagcttctggttttcggcggagggaccaagctgaccgtcctaggt

SEQ ID NO: 237 - DNA, 741 bp, Artificial Sequence
  CDS (1)..(741): Polynucleotide encoding NGG2017 scFv protein
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtgtattactgtgcgagagagggacattttgattacgtttgggggagtttttccctctgggggcaggggaccacggtcaccgtctcgagtggaggcggcggttcaggcggaggtggctctggcggtggcggaagtgcactttcctatgtgctgactcagccaccctcagtgtccgtgtctccaggacagacaaccagcgtcatctgctctggaaataaattggaggataaatatgtttcctggtaccagcagaagccaggccagtcccctgtcctagtcatctatcaggatgccacgcggccctcagggatccctgagcgattctctgcctccaactctgggaacacagccactctgaccatcagcgggacccaggctatagatgaggctgactattactgtcaggtgtgggacagcagcactggtgtggtcttcggcggagggaccaagctgaccgtcctaggt

SEQ ID NO: 238 - DNA, 765 bp, Artificial Sequence
  CDS (1)..(765): Polynucleotide encoding NGG2022 scFv protein
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtgtattactgtgcgagagatcccgtaggtggaagttacgatttttggagtggttccctgcctatctttgactactggggccgagggacaatggtcaccgtctcgagtggaggcggcggttcaggcggaggtggctctggcggtggcggaagtgcacagcctgtgctgactcagcccccctcagcgtctgggacccccgggcagagggtcaccatctcttgttctggaagcagctccaacatcgcaagtaatactgtaaactggtaccaacaactcccaggaacggcccccaaactcctcatctatagtactaatctgcggccctcaggggtccctgaccgattctctggctccaagtctggcacctcagcctccctggccatcagtgggctccagtctgaggatgagggtgatttctactgtgcaacttgggatggcagcctgaagggttgggtgttcggcggagggaccaaggtcaccgtcctaggt

SEQ ID NO: 239 - DNA, 768 bp, Artificial Sequence
  CDS (1)..(768): Polynucleotide encoding NGG2043 scFv protein
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtgtattactgtgcgaccctggcaagcgccgatacaggtatggtcacagactacaaatactacgatatggacgtctggggcagagggacaatggtcaccgtctcgagtggaggcggcggttcaggcggaggtggctctggcggtggcggaagtgcacaggctgtgctgactcagccgtcctcagtgtctggggccccagggcagagggtcaccatctcctgcactgggggcagctccaacatcggggcacctaatgctgtccactggtaccaacatcttccgggaacagcccccaaactcctcatctttgataacaacattcggccctcaggggtccctggccgattctctggctccaagtctggcacctcagcctccctggccatcactgggctccaggttgacgatgaggctgattattactgccagtcctttgacaacagtctcgatggttgggtgttcggcggagggaccaaggtcaccgtcctaggt

SEQ ID NO: 240 - DNA, 741 bp, Artificial Sequence
  CDS (1)..(741): Polynucleotide encoding NGG2051 scFv protein
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtgtattactgtgcgaggcatgatattctatttccctacgtggacgtctgggggagagggaccacggtcaccgtctcgagtggaggcggcggttcaggcggaggtggctctggcggtggcggaagtgcacttaattttatgctgactcagccccactctgtgtcggagtctccggggaagacggtaaccatctcctgcacccgcagcagtggcagcattgccagcaaccatgtgcagtggtaccaacagcgcccgggcagttcccccaccattgtgatctatgaggataacctaagaccctctggggtccctgatcggttctctggctccctcgacagctcctccaactctgcctccctcaccatctctggactgaagactgaggacgaggctgactactactgtcagtcttatgatagcagcactgtactgttcggcggagggaccaaggtcaccgtcctaggt

SEQ ID NO: 241 - DNA, 732 bp, Artificial Sequence
  CDS (1)..(732): Polynucleotide encoding NGG2053 scFv protein
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtgtattactgtgcgagagagatggcttacggtgacttcgaccactgggggcgggggaccacggtcaccgtctcgagtggaggcggcggttcaggcggaggtggctctggcggtggcggaagtgcactttcctatgtgctgactcagccaccctcagtgtcagtggccccaggagagacggccaggattgcctgtgggggaaacaacattggaagtgaaagtgcgcactggtaccagcagaagccaggccaggcccctctactagtcatttattatgatagcggccggccctcagggatccctgagcgattctctggctccaactctgggaacacggccaccctgaccatcaccagggtcgaagccggggatgaggccgactattactgtcagatgtgggatagtagtagtgatcattgggtgttcggcggagggaccaaggtcaccgtcctaggt

SEQ ID NO: 242 - DNA, 765 bp, Artificial Sequence
  CDS (1)..(765): Polynucleotide encoding NGG2071 scFv protein
gaggtgcagctgttcgagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtgtattactgtgcgaccctggcaagcgccgatacaggtatggtcacagactacaaatactacgatatggacgtctgggggcgagggaccacggtcaccgtctcgagtggaggcggcggttcaggcggaggtggctctggcggtggcggaagtgcacagactgtggtgatccaggagccatcgctctcagtgtcccctggagggacagtcacactcacttgtgacttaaactctgcctcagtctctactaatcacaatcccagctggtaccagcagaccccaggccaggctccacgcacgctcatctacaacacaaatactcgctcttctggggtccctgatcgcttctctggctccatccttgggaacaaagctaccctcaccatcacgggggcccaggcagatgatgaatctatttattactgtgcgctgtatatgggtagtggcattgtggtattcggcggagggaccaagctgaccgtcctaggt

SEQ ID NO: 243 - DNA, 738 bp, Artificial Sequence
  CDS (1)..(738): Polynucleotide encoding NGG2086 scFv protein
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtgtattactgtgcgagagaaattagtagtgtccccaactggttcgacccctggggcagaggaaccctggtcaccgtctcgagtggaggcggcggttcaggcggaggtggctctggcggtggcggaagtgcactttcttctgagctgactcaggaccctgctgtatctgtggccttgggacagacagtcaggatcacatgccaaggagacagcctcagaaactattatgcaagctggtaccagcagaagccaggacaggcccctttacttgtcatctatgctaaagacatccgaccctcagggatcccagaccgattctctggctccaggtcaggaaccacagcttccttgaccatcactggggctcaggcggaagatgaggctgactattactgtaactcccgggacaccactggtaaacatccggttttcggcggagggaccaaggtcaccgtcctaggt

SEQ ID NO: 244 - DNA, 738 bp, Artificial Sequence
  CDS (1)..(738): Polynucleotide encoding NGG2103 scFv protein
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtgtattactgtgcgctacattactatggtttggggagttttgacttctggggccggggaaccctggtcaccgtctcgagtggaggcggcggttcaggcggaggtggctctggcggtggcggaagtgcacagtctgtgctgacgcagccgccctcggtgactggagtccccgggcagagggtcaccatctcctgttctggaagcacctccatgatcgaacgtgctgatatcagttggtaccagcaactctcaggagaggctcccaagctcctcgtctttgctaatgttgtcccatcgtcaggcgtctctgaccgattttctgcctccaagtctggcacctccgcctccctggccatcagtgcgctccggtctggggatgaaggggattattactgtgcagccttccatgacggcctgaatgattgggtgttcggcggcgggaccaagctgaccgtcctaggt

SEQ ID NO: 245 - DNA, 741 bp, Artificial Sequence
  CDS (1)..(741): Polynucleotide encoding NGG2105 scFv protein
gaggtgcagctgttggagtctgggggaggcttggtacagcctggggggaccctgagactctcctgtgcaacctctggattcacctttagcagctatgccatgagctgggtccgccaggctccagggaaggggctggactgggtctcagctattagtggcagtggtggtagcacatactactcacactccgtgaagggccggttcaccatctccagagacaattccaagaacacgctgtatctgcaaatgaacagcctgagagccgaggacacggccgtgtattactgtgcgagagagggacattttgattacgtttcggggagtttttccctctgggggcaggggaccacggtcaccgtctcgagtggaggcggcggttcaggcggaggtggctctggcggtggcggaagtgcactttcctatgtgctgactcagccaccctcagtgtccgtgtctccaggacagacaaccagcgtcatctgctctggaaataaattggaggataaatatgtttcctggtaccagcagaagccaggccagtcccctgtcctagtcatctatcaggatgccacgcggccctcagggatccctgagcgattctctgcctccaactctgggaacacagccactctgaccatcagcgggacccaggctatagatgaggctgactattactgtcaggtgtgggacagcagcactggtgtggtcttcggcggagggaccaagctgaccgtcctaggt

SEQ ID NO: 246 - DNA, 732 bp, Artificial Sequence
  CDS (1)..(732): Polynucleotide encoding NGG2123 scFv protein
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtgtattactgtgcgaaagaccagagctggggcacctttgactactggggccggggaaccctggtcaccgtctcgagtggaggcggcggttcaggcggaggtggctctggcggtggcggaagtgcacagtctgtgctgactcagccaccctcagtgtctgtggccccaggacagacggccaggatgacctgtgggggcgacaacattggaactagaactgtgcactggtaccagcagaagccaggccaggcccctgtgttggtcatcttttatgatagcgcccggccctcaggtatccctgagcgattctctggctccaattctgggaacacggccaccctgaccatcagcagggtcgaagccggggatgaggccgactattactgtcaggtgtggactactactagtgatcatcagtgggtcttcggcggtgggaccaagctgaccgtcctaggt

SEQ ID NO: 247 - DNA, 759 bp, Artificial Sequence
  CDS (1)..(759): Polynucleotide encoding NGG2251 scFv protein
gaggtgcagctgttggagtctgggggaggcttggtacagcctggggggtccctgagactctcctgtgcagcctctggattcacctttagcagctatgccatgagctgggtccgccaggctccagggaaggggctggagtgggtctcagctattagtggtagtggtggtagcacatactacgcagactccgtgaagggccggttcaccatctccagagacaattccaagaacacgctgtatctgcaaatgaacagcctgagagccgaggacacggccgtgtattactgtgcgagagaagaatactatggttcggatattttcttggggaatgcctttgatatatggggccagggaaccctggtcaccgtctcgagtggaggcggcggttcaggcggaggtggctctggcggtggcggaagtgcacagtctgtgttgacgcagccgccctcagtgtctggggccctagggcagagggtcaccatctcctgcagtggaagcaactccaacatcggggcaggttatgatttaaattggtaccaacaacttccaggaacagcccccaaactcctcatctatggtaatgccaatcggccctcaggggtccctgaccgattctctggctccaagtctggcacctctgcctccctggccatcactgggctccgggctgacgatgaggctcattattactgccagtcctatgacaacaggctgagtggtgtgatattcggcggagggaccaagctgaccgtcctaggt

SEQ ID NO: 248 - protein, 249 aa, Artificial Sequence
  scFv protein NGF3C11
QVQLQESGPGLVKPSGTLSLTCAVTGDSITSNNWWSWVRQAPGKGLEWIGDVYHTGTTNYNPSLKSRVTISVDESKNQFSLKVTSVTTADTAVYYCAREEYDVWSGPMDVWGQGTLVTVSSGGGGSGGGGSGGGGSAQAVLTQPSSVSGAPGQRVSISCTGSSSNIGAGYDVHWYQQLPGTAPKLLIYGNINRPSGVPDRFSGSKSGTSASLAITGLQAEDEADYYCQSYDSSLRAAVFGGGTKLTVLG

SEQ ID NO: 249 - DNA, 747 bp, Artificial Sequence
  CDS (1)..(747): Polynucleotide encoding NGF3C11 scFv protein
caggtgcagctgcaggagtcgggcccaggactggtgaagccttcggggaccctgtccctcacctgcgctgtcactggtgactccatcaccagtaataactggtggagttgggtccgccaggccccagggaaggggctggagtggattggggatgtctatcatactgggactacgaactataacccgtccctcaagagtcgagtcaccatatcagttgacgagtccaagaatcaattttccctgaaagtgacttctgtgaccaccgcggacacggccgtttattactgtgcgagagaagaatacgatgtttggagtggccccatggacgtctggggccagggcaccctggtcaccgtctcgagtggaggcggcggttcaggcggaggtggctctggcggtggcggaagtgcacaggctgtgctgactcagccgtcctcagtgtctggggccccagggcagagggtcagcatctcctgcactgggagcagctccaacatcggggcaggttatgatgtacattggtatcaacaacttccaggaacagcccccaaactcctcatctacggtaacatcaatcggccctcaggggtccctgaccgattctctggctccaagtctggcacctcagcctccctggccatcactgggctccaggctgaagatgaggctgattattactgccagtcctatgacagcagcctgagggctgcggtattcggcggagggaccaagctgaccgtcctaggt

What is claimed is:

1. An isolated single chain antibody comprising amino acids 31-36 (VH CDR1), 51-66 (VH CDR2), 99-110 (VH CDR3), 160-173 (VL CDR1), 189-195 (VL CDR2) and 228-238 (VL CDR3) of SEQ ID NO: 65, wherein the antibody specifically binds the polypeptide of SEQ ID NO: 2 (NogoR).

2. An isolated single chain antibody comprising the VH and VL domains of the amino acid sequence of SEQ ID NO: 65, wherein the antibody specifically binds the polypeptide of SEQ ID NO: 2 (NogoR).

3. The isolated antibody of claim 2, wherein the antibody consists of the amino acid sequence of SEQ ID NO: 65.

4. The antibody of claim 3, wherein the antibody binds the polypeptide of SEQ ID NO: 2 (NogoR) purified from a cell culture, wherein the cells in the cell culture comprise a polynucleotide encoding amino acids 1 to 473 of SEQ ID NO:2 operably associated with a regulatory sequence that controls gene expression.

5. The antibody of claim 3, wherein the antibody prevents binding or inhibits interaction of NogoR with a molecule selected from the group consisting of:
(a) p75(NTR);
(b) LINGO-1;
(c) Nogo;
(d) Omgp; and
(e) MAG.

6. The antibody of claim 3, wherein the antibody promotes neurite outgrowth or axonal regeneration.

7. The antibody of claim 2, wherein the antibody binds the polypeptide of SEQ ID NO: 2 (NogoR) purified from a cell culture, wherein the cells in the cell culture comprise a polynucleotide encoding amino acids 1 to 473 of SEQ ID NO: 2 operably associated with a regulatory sequence that controls gene expression.

8. The antibody of claim 2, wherein the antibody prevents binding or inhibits interaction of NogoR with a molecule selected from the group consisting of:
   (a) p75(NTR);
   (b) LINGO-1;
   (c) Nogo;
   (d) Omgp; and
   (e) MAG.

9. The antibody of claim 2, wherein the antibody promotes neurite outgrowth or axonal regeneration.

10. The antibody of claim 2, wherein the antibody is conjugated to a detectable label.

11. The antibody of claim 2, wherein the antibody is biotinylated.

12. The antibody of claim 2, wherein the antibody is conjugated to a therapeutic or cytotoxic agent.

13. The antibody of claim 2, wherein the antibody specifically binds NogoR in a Western blot.

14. The antibody of claim 2, wherein the antibody specifically binds NogoR in an ELISA assay.

15. An isolated cell that produces the antibody of claim 2.

* * * * *